United States Patent 10,233,495 (METHODS AND COMPOSITIONS FOR SCREENING AND TREATING DEVELOPMENTAL DISORDERS) - sequence listing, part 21

SEQ ID NO: 97 - DNA, 742063 bp, Homo sapiens
  misc_feature (374233)..(474232): n is a, c, g, or t
aggaaaagttgttgaggttataaaggatgaactctaggtatgttgaacattggtctgaagctattgtgtagtgattaagagagtaagctttgcagtcataatgacgtgggtacaaattccagctctgtctctcaatagcatgagaccttagagaaattaacttctaatctttagtatcttaataaatgggaatttagaaataatttccaaaggattgctataatgtttcaaatgatttttttaaaggcagttaagtgatcaataagctggagctattgttatttttattgtttctgtagttcaggaaagatggattgttctaacaattattgttggtgaacttaaccagaaaatgtagtattgagtgactcagatttttggcctagctatgggtggaaataactttctgggtaaagatgctgaactaaaaacttgcagccaaaaatcctcttcagacctcagggatcatcacaatataattgtaaaaatataacaatgaacatggaagtacagatatctcttttgagagcctgatttcaattgttttggatatatacacagaaatagaattgctggatcatatggtagttctatatttgaggaacttccatactcttttttttttttatatagtcgctgcaccgttttacattcctgctatggtgtataagtattccaatttctccgtatccttgccaaaacctggtatcttttgaaacaacttatacgtctgttgaaagatgaatgggttaaaaaacatatggtttatacattcaattgaatactattcagtcttaaaaaagaagaaaatcggccagtcacagtggcttatgcctgtaatctcggcactttgggaggccaaggcaagccgatcactagacgccaggagttggagatcagcttggcatacatggcgaaaccccatcactactaaaaatacaaaagttagcctggcatggtagctcgcacctgtaatcccagctactcaggaggctgacaggacaatcggttgagcctgggaggcagaggttgtagtgacccgagatcgcaccactgcactccagcctaggccgcagaggagagactgtgtctcaaataaaaataaaaataaaaataaaaaaaggaaatcttgctgtatgtaacaacatgaatgaccctggaggatgttctgctaagtgaaataaatcagtcggagaaggacaaatactgtactgcatgattccacttctatgaagtatctaaaatattcacattcacggaaacagtaagatggttgttgccagggactagggggaaagggaaatggggagttgctgttcaacaggtataaagttttatttctgcaagacaaataagttatagagagctgctgtacaatgttgtgcctgctgttaatgatactgtattctgcacttaacattttgttgagggtagatttcatgttcaaggttcttactgcaataaaattttttttaaaaaacctcaataattaccaaaaaattatttcaatatgtagtaaaaagaaatataatgcttctgaaggcagttccttttgtactgatgataacgaattgtgaattgagatgagtggaatttagcaataaaaagtgtcaagagcattgggcaatattgatgtcaattctacctaatttcatctatagatttggaacaatcccaatcaaaacctcagtgctttttaacagaaattcacaatattgagtttcttgttaattgaaatttacaaggaaaggtaatggatataggatatcgaaaacaattttggaaaacaacaacaattttggaggactagcattacctgatttcagggcttactacaaacttatggtatcaagatagtgtggtatttatgtaaagtaagacaaatacatcaatagatcagaacacagtgtccaaaagtagagtcacagatattatggtcaattgaatttgacaaaggtaccaacataattgaaatgtgtagaaggatagccttttcgacaaatagtgttgaggcaattagatatacatatggaaataaatgaccgtgacccctaccttacataatacacaaaaattaattcaaaatggatgataggtctaaatataaaagttgttttaaaacttctagaagaaaacatgggagaaaatttttaccaccttggagtaggaaaagatttctcatataaaataatcacaagtcctaacatttttaaaaattaatacaattgcagctcaaaaaattaaaatgttatggtctttaaaagatgctaaatgaataagtaagtgaataaggcacattacagactaggagaaaatagttacaaaacatttgtccaacaaaagactcgtaggatatatacagagagaggacttgctactcagtaaaaagacaaatatcccaatttgaaaaaatagacaaaagacttcatcatagaagatgtgttgaacaggcaattatcacatcattgtcatcatgaaatatcacttcaatcccactggaatggctaaaattaataagattggaaatagcaagtgtcgcacaggcatggtggctcacacctgtaatcctagcactttgggaggctgaggcgggaagattgtttgggcttggagtttgagaccagcctgggcaacatagtgagacatctctacaaaaaattttaaaaattagcagggcatggtagcacatgcctgtagtcccagctatttgggaggctgaagtgggaagaactcttgagcctggggaggagagggctgcagtgagccctgattacaccactgcactccatcctgggtgacagagtaagaccctgtgtcaataaataaataaatacataataaaaaatgaaaatagcaaatgttggcaaggatctgaagcaattagagcatttatactttgctagtaggaatataaaatagtacaaccactttggaaaacagtagtaattatttattatgaatctaaacaagtacttatcataggacccaatatttcccctcctaacaaaaacaaattgtgtcatatttatcagtcaaaatactgctcagcaataaaacaaaaactacacatgacaacatggatgaatctcacatatatgctgagtgaaagatgctggacacaatatggttgagatgacactagtcattaagaaataaatcacatttgtggttcccaggtgcaagaatgttggggaagtttaatggcaaaggagcatgagaaaccttctagggagatggaaatgctctatatcttgattgttgtggtggttacgtggatgaatacaaagactctctccttgaccaaacttagtcaggctcctctgataccttttgtcaactagaccttgaccttaggcttccatgtctttatttgttcagttttagctagactcctgctaagtcactttagtaagagtcccttgcttttggtatctggtcaccttcaaaatctgatcaaattcattattctctaccttcccccagatgatatctgatcaccctaacctgcctttagaaagaatactatcaaatcagtttagcaagaatctcctcttaccccttgctatgatttggatgtttgtcccctccaaaatcatgttgaaatttaattgccattgtaacagtattaagaagtgagacccttaagaggtgattaggcaataaaggctccaccctcataagtgggactgatattataaaaaggagacttcaaccctctgttggcctttttgccttccaccatggaatgatgctgcaagaaggctcttaccagatgtcagcaccttgacattgaacttctcagctttctgaactatgaaccaataaatttctgttcattataaatgacccagtctcttgggccaggcatggtggctcacgcctgtaatcccagcactttgggaggccaaggtgggtggatcacttgagatcaggagttcaagaccagccttatcaacatggagaaaccccgtctctactaaaaatacaaaattagccaagcgtggtggttcatgcctgtaatcccagctactcaggaggctgagacaggagaatcgcttgaacccgggaagcggagatttcagtgagccgagattgcgccattgcactccagcctgggcatacagagcaagactccgtctcaaaaaaaaataaataaataaataaataaataaataaattacccagtctcaggtattctgttacagcagcacaaaatggacaaagacacccctaatgtttcctcttagtaattttcaatccactgacccccaaccctgttcatttgctataaatctccccttgttcatgctgtattcagaattgagcccaattccatactgaggtttattttcctacattgcaatatttactaaataaaatttgttttttctgctctagctactattcaactgtgattttctttaacagtgtaatgcagcagagtcatttgtgttgtgccaagttcctgcctgtgaaatttagcatatgttgtagttttaaaataactaacattttaccaatacatttacttataacttctttttgacatatattatcttatttaacattctgaaacagcttgtgatttaattacaataacaccaattatatttttaattgaaaaataaataaaaggaatatttaaatatcactgggtattcttaaatttggaaatgtattaatcttcagatttaagaccaggtacctaagccttttcttccacagtaggatgtcaatgttaaattttcatttagcttttacatgtaccacagaatgcagccttgaatcctttaatagcaattatattggtttattgagtttcataacaggaaatagactatcaaaatataagtacttccaaaaaaagataacattttacaaggcccttttttggaaaacatggttaattattcctgagatatttatagaattctggaattctgaagttgttctgcttacttttgagtaatatcggtagctgacattttctgagtactgactgtgcccaatctgctctgtgtgctgcctatattttacctcacttaattcttatcacagtcttataagggattttttttttttttttgagacagagtatgccctatgtggcccaggctggagtgcagtggtgcgatcttggctcactgcaacctctgtttcctgggttcaagcgattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataaccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttactcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacggaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctgccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtggggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcacgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgttttttggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacatggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcaactgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaaccttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctgtgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggtctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccacatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaagtgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagcctggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagagaattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgaacaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggacgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctgaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagatgaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacgtgatatttaaaatatataacaattagtacaacatagggcactgaccaatcagaacagacaccagccaaactgctagagcagcttcctggatgctgtgcccttcatgtccggattatgagtacacctctggtgggctggggcagaggcatggggcagggtctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacatgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagattgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtgatgaggatgttgggaaataagagacctcccattcaacttaagggaaagtaagctgttgcaaccattccagggagcaacctgaaagtacttggtaaattaactatctttatactttctcaatgatgtagcaattacacttctaggtctcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggactatatagcacaacctattagaggaaatggctgaaatagtattctcttaatgtttaatgtgactattaagagggtattatgctggcatgtaaaacagttaattgtattcagtgtgttttaacatcactgattaattgatggcatagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgtttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtacctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaaggcaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacataaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaattagccgggcgtgacggcgggcgcctgtagtcccagctactcgggaggctgaggaaggagaatggcgtgaacctgggaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcgctgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgcttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggactgttggcttatttggaaaagtgtagtaataaaagagatgttcccagaagaagattgaccaattgatgaacagaaatgaaagtagagagagaacagaaatttagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccagatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtttattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgagtcagtgatggggcgaatatgtttcatgtgtggaaagataaataaaagggatgatgcatgaccagaaaggaggactgtggcagaaacagcctagatgctcaccaatcttatttctactgtttgggcagatggaaactgctatagttcaaagcctctcttggagttagattgcaatcatatgactgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagctgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtagttaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccactttttttttgaaacggagtttcactcgtgttgcccaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttaccatgttggccaggctggtctggaactcctggcctcgtgatctgcctgcctcagcctcccaaagtgctgagattacaggcgtgagccacagcgcccggccatactttattctttatgatacaatgtctcactctgttgtccaggctggaatgcagtggcagaatcacaggtcactgcagccttgacctcctgggctaaagtaatcctctaccccagccttccaagtagctgggaccacaggcgtgcaccaccacgcctggctaatttttaaattttttgtgggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaacagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccactcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaacctcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcacccaccaccatgcctggctaatttttgtgtttttagtagagacggggttttaccatgttggccaggctggtctcgaactcctgacctcaggtgatccacccgcctcggcctccctaagtgctgggattacagtcatgaaccaccgtgcccggccgagagatgaatattaaaacatatttgagggactttagaaattgtcagtctttaaagtctgtaagaaggatggtctggatgactcctttagcatgaactcattatttagtagatgactccatcccaattagtatttatgcctgtggaaatctcatatgaagagctagatctgattagcagctctattatatctagcttaatgctcacaatttgttccacaaagccattctctctctctctctcgtctttccctccttccattttgttagatcacatattataatagttatatgctttaaacccttatttagaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagctgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttctacgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttattcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggattacctagctagtaaaatgaatgcaggaaaaagggaaaggccaagaacagtcacatctatctgtcttttcattttgtttcttcttttgcttttcatgcttagaaattctttctccgcctagagatgaaatgaatattcaattatggtttcttccaattgtttctggtgctcatttttatatttatatttaacctaagataatctgggatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcccgcttgcaatgtgcatctgaagccaggaggatgtctctccaactgatcgtatatttctttcttgtttttcctttttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataattcaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttataggaagcagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatcttggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggacggagccctcagtttgtggaatctgactctacctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagtcctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattggtcacagccagtgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacctgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgtcccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccagtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggagtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgagaaggagctaattgctagacttgtattactacttgcaatgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctccctccctccctcctttctttctttctttcttccttccttccttccttccttccttccttccttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggcgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctaggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagtcctgccaacatcttgaatttagtaagattactgtgacttctaatcttgtggcttttgtcggtctagtccacaggcagtaaggtttgttttgggaaaggactgttatcatctttctttcaaagctaaactataaaataagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccatttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactgaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccatcttgggcacatgtcatcaggacctcctgagactgtgtcacgggagcaagtcctcagcactggcaaacttactaaattgactgagacctgtcttagatttttggggttcacaacattcattagctattgggggtctaggactgaaatttaaaggcatagatgaagtctgacagatccaatctgatgttaactttgggattttctttagttaccactcagtgccccagtcctccttaaaatactttacacctccaagtctttttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagacccaatggtaaataaaccctgactgtcattcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatacttttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcccggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttttattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgttgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccaccctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaaaaaaaaggaagtggagaggaaggggaagggttgtctgcaatgagctagaaagttagtcttttttttttttttaaataaggaaaggaatgcgaggtggtactgataatgcctggtactgtagcgtgcctgggcattaaaggagaaaaacggaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaaaaaagaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaagtaacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacactcatatttattgacagcattgtttggcctcttatatatataaaatgtcatttattttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgcgcattaggccagggacatcaggcttcaagtaaatctaaaatctaggagattattctttgtagggtagaggagacgcaaaggacataggtttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatataccgtatatatatatatatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggaaaattttaggctattacctcctgaaatattttttccctacattctgtctaaatctattgaaaagagttacgagtgggtaggtaatttggtgactggtctcttggtatgagagcatctcattccttttggtgtcaccaattctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcgtggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacagagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagccactgcacctggcctcatttagattttatgttatttatttatagcttgataatattttgtcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgttttgttttgtttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtattttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctatcatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggatattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccatcagtgttctgtattcagtaaacccatctcacatgcagagacacacataggctcaaaataaaaggatggaggaagatctgccaagcaaatggaaaacaaaaaaaggcaggggttgcaatcctagtctctgataaaacagactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccaccccaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaagaaactcactcaaaaccgctcaactgcacggaaactgaacaacctgctcctgaatgactactgggtacataacgaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcacactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaagggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcaggacataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaactccatcaaaaaatgggcaaaggatatgaacagacaattctcaaaagaagacatttatgcagccaacggacacatgaaaaagtgctcatcgtcactggccatcagagaaatggaaatcaaaaccacaatgagataccatctcacaccagttagaacagcgatcattaaaaagtcaagaaacaagaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacagcatggaatactatgcagccataaaaaaggatgagttcatgtcctttgtaggtacacggatgaagctggaaaccatcattctgagcaaactatcgcaaggagagaaaaccaaacaccgcatgttctcactcataggtgggaattgaacaatgagaacagctggacacagggcggggagcatcacacattggggcctgtcgtggggttggggaagcagggagggatagcattaggagagatacctaatgtaaacgatgaattaacaggtgcagcacaccaacatggcacttgtatacatatgtaacaacctgcccgttgtgcaaatgtaccctagaacttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtaaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaagtctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaataaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttaccttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttctttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaattcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagagtggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttagtatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatctttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccctggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttctcttgttttcttttctattttttctattttttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacagcatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtatacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttttgatcttagaggaaacccaaaaggtgttcacttaggtctggttttaaacaggcagaacaacatattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagattgtgccactgtactgcgccactgcactccagcctgggtgacagagcaagactctgcacccccaaccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctaaattctagattctggggatagagccaaggaggacaagctgaagttctcagttttaagtgactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcctaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacgctttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgaggggaaagaaaggtaatcatatttatgttagtttcacaatccaagttttaaattggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaaactaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttttttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgacacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatctgaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaggatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggctgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaaccatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaatattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctaccgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaggtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttactcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaagggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataattgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttttaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaaccattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacaaaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtgtgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagaataggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaataatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattaaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtagatatctataagataaaacaaatctatacattgtgtttttcagctagaggcagaaactcattgtcactatatcctagataaaatcttcttgatgttattaatcctacggattaatacgaaagtgcaggaaattatcgggtcatggaagagtcacagaaagtgcaggaaattatggggtatattttaataaaattactgaagacacatagataatatcttcacctatattataaaagtgctgagtctaggcctagcatttttcttcgcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctatagtggatctacagtatataggccaagatcttatgatgcacagggcagccccctacaacaaagaattaaatggttcaatatgttagtggtgccaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacactacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaagcttgagaatgattgggagtgaacaaagtgcactgggttttggcaagaaaatacctcatgaattttgggagatatgagtttagcataaattaaaaatagtgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcatcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctcctactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatcttaacaatggagtggacattatttagataacttgtggttctttcctaggcacccaactttttgctcaaagtagttaggaacaaattatcttcccaaatattattgttctaaacatatgtagtctaagattctgtatcactatcttttttttttttttttgagacagagtctccttgttgagacagagtctccaggcagaagtgcaatggtgcgatcttggctcactgcaacctctgcctcacaggttcaagcgattctcctgcctcagcctccccagtgattgggactacaggtgcccgcctaatttttccatttttagtagagacagggtttcaccatgttggccaggctggtctcaaactcttgacctcaggtgatctgccctcctcggcctccgaaagtgctgggattacaggtgtaagccaccgcacccggtatcccccgctttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcttcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtaggttgtgtaattttttgtttacttttctttgaaataattatatatctacaggaagttgcaaagatagtacagaggagtcacaacatctcacccagttttctccaatgattacatctcacataactatagttcaatataagatctgggaaactgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggctttttgttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaactgtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcttagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaatttttggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccgtccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccacttataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattatggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggaatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgtttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagaggtgccatacacttttaaacaatccgatctcacaagagctcactcactattgcaaagataactccaagccgtgagtgattggctcccatgacctgaacacctcccaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccaaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaaaaaaaaaaaaaaaaaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcatcttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaaattcttccattctttacctgttacccagttgccaagtcgctttcacattttccaatatctttatagcaatgccacactcatagttaccaattttctgtgttaggctgttcttgcattgctattaagaaatatctgaggctgggtaatttattagaaaagatgtttaattggctcatggcttttcagactttatagtaagcctgatgctggcattaacttagctcctagggaggcatcaggaagcttataatcatggtgggaggtgaaaggggagcaggaacatcatgtggtgaaagcaggagcgagagagagagagagtgggaggaggtgccacacacttttaaacaaccagatatcgtgacagttcacttgctatcgcaaagacagcactatgctgtcagggatccgttacccaaacaactcccaccagcctcacttccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttcctgtgcagaagctctttagtttaattagatcccagttgtcaatttttgttttagttgcaattgcttttagggtctttgttataaaagctttgctaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatacccagcaccatttattgagtagggagtcctttccccatttcttgttatggtcagctttgtcaaagatgagatggttgtagacatgcagctttacttctggcttctctatttggttccattgatctatgtgtctactttttttgtactagcaccatgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgaccaggctggagtgcagtgccacaactatagttcactgcagccttgaactcctgggctcaagcgatcctcccacttcagtctcctgagtagcggggactataggcattcaccaccacacatggctaattttttagatttttggtagagatggagtcttgccatgttgctcatgctggtcttgaactcctgagctcaagcaatcctcctgcctctgcctcctaaagtgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttaatgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtagtgagagtgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggttttgccatgttggtcaggctggtcttgaacacttgacctcaggtgatccacacatctcggcctcccaaagtgctgggattacaggcatgagccaccgtgcccagccatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccttgttggctgtttttttaaaattactggttcaattttggaactcattatttatcttctcaggtattcaatttcttcctggttcaatattgggagtttgtgtttccaagaatttatccattccttctagattttctagtttgtgtgcacagaggtgtttacaatcatctttgaaattttttgtaaaaaatatttctcttccctttggcatttctgatggtgcttatttgaaagttctttcttttttttctttgttagtcttgctagcagtgtatcaatcttatttattctttcaaagaacaagttgtttggtttcattgatcttttatatggatttttgtgtctctatttcattcagttcagctctaattttggttatttttgtcttgtgctagtttaggggttcacttactcttgtttttctagttcctcaaggtgtgatgctacattgttaatttaagatatttatatcttttcgatgttggcattttgccccataaactttcctgttaatactgctttacctgtgtcccagaaattctggcatgttgtatctttattttcattaatttcaaagaatttcttgctttctgtcttaatttcattctttactcaaaagacattcaggagcaggctgtttaatttccatgtaattgtataattttgagagatcttggtattgatttctatttttattgcactgtggtctgagagtgtgattggaatgatttttaaaaatttgtttagaattgctttatggccaagtgcatggttgatcttagagtatgtgccatacatatgcagatgaaaagaatgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgtttttcatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggtgcaatctgagctcactacatcctctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaagaatgctggctgagtataggtccccaatctcttttggcttataaggtttctgctgaaggttctgctgttatcctgatatcaccccctttgtatgtgacctgtccctttgctctactgcttttaagattttttctttcatgttgaccttggagaatctgacgacaaggcgtctggaggatgggtgtcttgtatgttatatctctggggttctctgaatttcttgaatttgtatgttaacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctaactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgcccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtcgtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaagtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatttactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgtgttgtggaatgggagggaacgaagagttcaaacaattgactggaaaggttttattcatctaagactttcccaaacagcaaatccttgaagggaatgagatccaggtgttagtgtacagtctagtcatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaagtaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaatatgtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcacatgtgcagacagatgtgatttcaacaactagactgtaaactccatgagggtggggacactaactggttcatttttatatccttcacagttcacaggaaactataatattgtttatggcagttgttctataaagatttattaaataaaaataaagagtaataaaagcaaacaaataaatatacgtgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctttatacctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtctctaacacattaatcagtacctctttggcgtagatgtagtcagcttaaattttacaatcactgtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatacaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttaaatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaatcaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccaggcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactacccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagaaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaagtagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcattggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacataaacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcttggtataaggcagaaaacattaaaagggtaaactgacccttttatgctctaagatataaacctctgtcatctcactgactaatgttttaaatgctagagtgaaagcaagtaaacattggctttggctgtgaatattctggtggcacacatttatgtcgttgatgaatagtgtaccttgaaaagccttaacccttacgccgttagcatttcatcttgttcatctgactgcccaaacatctatatttaaacaaatccacaggggatctgttctctaggactttgctggagaaccttgatgtgtcggaaaactgttcctattaatagaggaattatatctcgagtggctggcatatgttaactaatggatactattaatagtaataacaaaaataaaaaatcattacaatattactactatttgaatcactgactatgtatgagagacattataagtgttttatctatgttaagtatatttccaacacgacacaataggaggtaattgccattattatagaagtaggcataattatctctatcaacattctagtccacttttccatcattatctgttgcataaactcatgcaaaatcttctaaatgatctacacttttcacaatctggcctttttgcgatgtaatccattgacaacattgagagctttttaaagaaagggaatctgataatatctctccatttctgaactctgtgcagtagctcccctttgcccttaatagatacttagatctccttatagttatattgcttcaacttacctctctagcatcatctgctactttactcagctttttcctgcatactaatttgaaaccttaggcactgcctttacttcactacctgcttttctttttgtgttttcctctccccctcatcttttcatctactcctagacattattgaggactcactttatcaatgactttgagatctcttctacatgtttccttagcattgtgaccttataacacttttagacttttcctttttacttgcttatagtctatctttcaaagtacaacgtaaggcatgagggagcagaaagtgcctacatttcttctctgaaaatccagcacttatccgtggtttgtgctgatcaattcataaatattccttgaaggaatgacttatttttttttttacattgcacaatgaaggctttcattgaatcaaccctgttttcagagtctctttagtatccctctttgatatttaatgacactaaagtttacacagttgtgatgatatagcaacatatgagtttctaatggtaggtcactttctttgacctcccgtatttctctcactgtgagtcaaacactctgaatgaaaacatatctggccattccttctgaaatgcaaagcaaataaatcaaacatgaatacatttaccttaggcagggttttggctggtttacagtggagttcccccacaaaatcgacatttggtaagggtgggtgaagaaattcaaaatcccagtacgtttgaatgagccacacttcagctttccccattgtctcaaataatgtacattaataaaataaatatatacatatatttttatatataagcataacaattttatatattgcatattacttatatataaggaaagcaaaatgttcagagaattaagaggaaattacatatatttttttctttttcttttttttattatactttaagttttagggtacatgtgcacattgtgcaggttagttacatatgtatacatgtgccatgctggtgcactgcacccactaactcgtcatctagcattaggtatatctcccaatgctatccctgccccctgcccctaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaataatgtcacaataaacatacgtgtgcatgtgtctttatagcagtatgatttttagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcattttttcatgtcttttttggctgcataaatgtcttcttttgagaagtgtctgttcatgtcctttgcccactttttgatggggttgtttgtttttttcttgtaaatttgtttgagttcattgtagattctggatattagccctttgtcagttgagtaggttgcaaaaattttctcccattctgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgcatctgtaaattaccttgggcagtatggccattttcacgatatcgattcttcctacccatgagcagggaatgttcttccatttgtttgtatcctcttttatttccttgagcagtggtttgcagttctccttgaagaggtccttcatatcccttgtaatttggattcctaggtatttaattctctttgaagcaattgtgaatgggagttcactcatgatttggctctctgtttgtctgttgttggtgtataagaatgcttgtgattttggtacattgattttgtatcctgagactttgctaaagttgcttatcagcttaaggagattttgggctgagacaatggggttttctagatatacaatcatgtcttctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggatacgctttttgatgtgctgctggattcgatttggcagtattttattgaggatttttgcatcaatgttcatcaaggatattggtctaaaattctcttttttggttgtgtctctgcctggctttggtattagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaagctattgattattgccataatttcagatcctgttattggtctattcagagattcaccttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctactttgattgtactgtggtctgagagatagtttgttgtaatttctgttcttttacatttgctgaggagagctttacttccaagtacgtggtcaattttggaataggtgtggtgtggtgctgaaaaaaatgtatattctgttgatttggggtggagagttttgtagatgtctattaggtccgcttggtgcagagctgagttcaattcctgggtatccttgttgactttctctctcgttgatctgtctaatgttgacagtggggtgttaaagtctcccattattaatgtgtgggagtctaagtctctttgtaggtcacttaggacttgctttatgaatctgggtgctcctgtattgggtgcatgtatatttaggatagttagctcttcttgttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgggatgggtttcctgaatacagcacactgatgggtcttgactttttatccaatttgccagtctgtgtcttttaattggagcatttagtccatttacatttaaagttaatattgttatgtgtgaatttgatcctgtcattatgatgttagctggttattttgctagttagttgatgcagtttcttcctagtctcaatggtctttacattttggcatgattttgcagcagctggtaccggttgttcctttccatgtttagcatttccttcaggagctcttttagggcaggactggtggtgacaaaatctttcagcatttgcttgtctgtaaagtattttatttctccttcacttatgaaacttagtttggctggatatgaaattctgggttgaaaattcttttctttaagaatgttgagtattggcccccactctcttctggcttgtagggtttctgccgagagatccactgttagtctgatgggcttccctttgagggtaagcccacccttctctctgtctgcccttaacatttttttcttcatttcaactttggtgaatctgacaattatgtgtcttggagttgctcttctcgaggagtatctttgtggcgttctttgtatttcctgaatctgaatgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttatttgcctttggtttgaatgtcctcccgtacctcagagtaatttgatcgtctgaagccttcttctctcagctcgtcaaagtcattctccatccagctttgttccgttgctggtgaggaactatgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccccaccgtgtgaggtgtcagtgtgcccctgctgcggggtgcctctcagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttccctgttgctttgtttacctaagcaagcctgggcaatggcgggcgcccctcccccagcctcactgccaccttgcagtttgatctcagactgctgtgctagcaatcagcgagactccatgggcgtaggaccctccgatccaggtgcgggatataatctcgtggtgcaccattttttaagcccgtcggaaaagcccagtatttgggtgggagtgacccgattttccaggtacgtccctcacccctttctttgactcggaaagggaactccctgaccccttgtgcttcccaagtgaggcattgcctcgccctgctttggctcacgcatggtacgcgcacccactgacctgtgcccactgtctggcactccctagtgagatgaacccggtacctcagatggaaatgcagaaatcacctgtcttctgcgtcgctcacactgggagctgtagacctgagctgttcctattcggccatcttcggaaattacatatttaatgtaacattagtatattcacaatctcaaatagttattaaaataagccactatggacttaaatatgcatttgtttcctctctgaaactgcagtagtaactgatatacatttaaacagctctttgagctccaggatgaattcatcttactatactcataaaaacagctttctacgaagtgcacaatctcgtttccacaatttatcaagtcagtcccttgatccttggttctccaagtgaactgtgagttttctgagagtatgcctgaaatccttgaacatactactgcttctagttcacgttaagattttaacaatattagctttaaaatacatacattaaaaatgatagctagtatattttcagaatttattgaaacagagatatgtgctcccccttaacttggcccatattttccctaataaagagatgtagttaataaagtatagattaaaagcttgaatgttcactttcaacaagattttaattcacaaagcaaataatttctcagttgttagtgaatgatatacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattgatagttatgctagaaatatgtgtagctcctcatctaaatgtctgccttcatcaagttgtttattgatatatgttttgccttttttaaagatgaaaaaagtatagtaaaatacgtatatagttgcttaaagaaatcataagtgctttactttgtagtttttttttttttaattcctgtagtgtcctataggagtgatgaccaaagggttctagctgagcctataatatcaacatttctataatatttgtgagattgatagatcatcttacatttggcattcatcatttcatttaaacaacactatcctcttacattatatttatatacgctcaccttcaaaggcaaaaggaaagttaggacttattaatcattgattagaaacatgacttacctagaacttcactgtaaaacttctcccacttctcgtatcaaacatttgaaaccaaaagtcaaaataaagcacatgtattagatttttaatcctctccacgaatgtcattttaccacttaattcagacagaacagcaggtatgcgggaaatggggaatggaagtcctccattatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgaaaaatatgaccaaaatgcatcttttggaagatcgtatatccatctattgatcagtttcacaacaagaccctcaaaattatttttaattagagatgttggataaacttcaaatttaatagcagatgatttactagggtcaataataatggaagccgaagatgtcaacacagtcatcttgtggcctctccaaacaagttcatccaggattgtctttatattcatccaatggctgtattctgtgggccacagcagcacctttccacaactcccagagctaaagtaacaactgagttgtatcaggagaatatttgacatcgatttcaatgtcctcctggtgcaatgcaatgtttcttttcaaattgctgtttctttctgtctttctcatacttacatctgagcataaatcaatcaagtgaaagtataactgctacaattcaaagtagcagttaccatataatttctaaattatcataggaattgtctgttaccatacaatttctaaattaccataggaattttcagattgtttttcacagtggttgcttccatttccattctcaccagcaatgtataagaattttaatttcttcccaacattgccaacacttgggattacatttcgtttgattatagccagtgtgaatgaagtgatatctcattatgctttacctttccttgatatgaaatcatgttgagaatgttttgcctagttttgattgaattatttgtcttcttatggacttgtgtttttaatatttttgatgtaagaaccttatcacatgtatgatttccttgtatttttttattctttgggctgtccttttactttcttaatggtgttaattgaagcacaaaagtattgattttaatgaagtccaactaatcaattttaatttggttgcttttatttttgattttatatctcacaaaccatttccaagttatgaaaattagtacctgttatttattattagagttttatagttctagtgcttacatttaagtttttgatcacctatgaattagcttttgtaagtgatttgaggtagagggtcccaacttaattattttgtatacagataatcatttttcccacttatatttgttgaataatctattctttcccctattaaaacgttttgaaacttttgtcaaaaactttaaatgcatgggcatatttctatgttctaaaatcattccattgatctacatgtctatctgtaggcctgtatcacactctcttgattatcatatatttgtatttgtctttaaaggcaggaaatgtaagttttccagcttttttttatttaaattgtttcagttttttttttaatttttttcttcttgtttttttttttttttttttaagagatagaagtcttactatattgcccaggctagattcaaatttctgggctcaagcaatcctcccaacacagcttcttgagtagctggaattacaggtgtgtttcactatacctagcttcttttggctattagtatgtctcttgaatatgtacataaatttcaggatcagtttgtctgtttatacaaagaagcaatctgggattttgatacggattgcattgatttggtatatcagtttggggagtagagtatggtcattatcacaattttaggtctttcaataaatgaaaatgagatgcctttctatttatttagatgttcttatttccacagtgttttgtagattttgttacagtggctagctagtcagacacaaacagggcagaagagggctcccacaccctaccaggaaagtcaggtgaccatcagttaatggccaggcagttgtcacactgtttaaaacaataattggttgcagccagccagggaaaggcagatttcttatagatagaaaaaatcaaatctggtaatcagcagcttcctgataagatctcagcagttgggagagtgggttcacacacacacattaagaggccaaatggtggagtacgacattccgggggcaccagaaaagggaagaatgcctcaggggagcatgcatatgactccagtaaatatactgtgcatgctcatctcctaagtggtagcaggccatcacacatgccagcaggtcattctaaggaaagaatcaaggaaaagggaagcaggacccggaaagtatgccaacatataaaaccctaagtcaaaggtcaaacaccacactttaccttcaaaatggctacttgtatctatcccaagtgtactttcctttctttcctgctataaaactttttaataaattttcacttctgttctgaaacttgtgctggtctctttttctgccttatgccgctcagtcaaattcattcttctgaggaggcaagaattcaggttgctgcagaaccataaatacttgctgcagtaaccaccgctggtaataatgtcacagtaagagttgtacaattttttgataaacttattgctaagaattatattttttcatggtattataggggtgactgtgtaatctttattttagtttaaatttccattgcaattgtgtagattttttgtttgtttatttaccttgtatcccaaaatcttgttttattagtttacttgaatattttttagtggatttgtaaaaattttctattataagatcatgatatatgccaatagagacagtttaacttctttctttctaatgtggattccttttatttcattttctttcctatttgttggctgaaagttctactgcaatattgagtgaaagtgagaagagtcagtttagtgtgatgttagctgtgtgtttttttatagacactattgatcagttttagaatgttcccctttacttctagtttaagtgttcttatcatgaagaatattgaatttcattaagtaagtttttctgcagttatcgaaatgattatgcagttttttcctttattctaatgatatgatatattagttggctttttcagatgttaacataactttgcattcctggaataaagttcatttgtttatggcatttaagcttttcatgtgttcctgaattttgtttgctagtgtgaaaagaaagtaaaaatcttgagtcattaaactcactatgtcaaagagaaaagttaatcttgggaaatgaagcatgtaaaattggctcccattttgttcctaaacagatagctgcaaagatagaaggccacatacctccccagatggcctccttcccaatttactcacaaggaaattcacaaggccctaaaacagagttctcttgaattttaccctgacaatataaattaacattttatattcacaggtatataaaagacaggacttgaagccattgtgtggtttttagcataagggcttactgaatggtggttatgttttctcctcttttattttttggagaattagttattttaaatacttgatagaagtatagagcttttatattttctactctaccatttccagttattacccagctatgtttttctaaataatatttcattggaagccgtcagacactgggcttttcttttatgggagactttttcttacagcttcaatcttgttacttgttattagtttgttcaggttttttatttcttcatgggtctattttggccggttgtatgtgtccaggaatttattaatatcatctaggttttccaaattgttggtatatagttgttcataatattctgtaataatttgtgtttctgtaatctcagtttttatgtctcctctttcacttctgattttatttagtgggtctgttctcactttttcttacttagtctagctaacagtttgttgattttgtttacttttacagagtttaccttattgactatggctgcttttgtactacaatggaagagttgagtaggcacaggagtccaaagggtttgcaaattccaaaaatgtttaccatctgaggctttatagaacctattctgatctctgctctacagtaagcaggttcgttttttcctttaacctttctatatattcaatgcaattttactaaaacagtatagatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttg

SEQ ID NO: 98 - DNA, 554710 bp, Homo sapiens
  misc_feature (186880)..(286879): n is a, c, g, or t
aataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttg

SEQ ID NO: 99 - DNA, 586533 bp, Homo sapiens
  misc_feature (205792)..(305791): n is a, c, g, or t
agatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatatttt

SEQ ID NO: 100 - DNA, 615119 bp, Homo sapiens
  misc_feature (205792)..(305791): n is a, c, g, or t
agatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaacataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttatgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccttatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgagctatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccttccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccctctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggatacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcactgcaacctccgcctcccagattcaaaagattctcctgcctcagcctcccaagtagctgggattgtaggtgcccacctccatgctcagctaattttttgtactctttttagtagagatagagtttcactatgttaaccaggctggtctcaaacgcctgagctcgtgatccacttgcctcagcctcccaatgttctgggattacaggtgtgagccaccgtgcctggcctcaacagtgttttatagttctccttgtacggacattttatcttcctggttaagtatgttcttaggtattatatttttttgcagttaaaaaagtgatggaatttttaaatttgattctcagcttggatgttattgctgtataactgtgctactgatttgtgtatattgattttgtaacctgagatgtaactaaatttgtttatcaaatctaggagtcttttgaagaaatctttagagttttctaggtatacaatcatatcataagtgaacagtgatagtttgacttcatctttttcaacttggatgtctttcatttcttttttttcccctgattgctctgactaggacttccagttctatattgaatagaagtgataaaagtgggcatccttgtcttgttccagttctcagagggaatttcagcatttccccattgagtataatgttggctgtgagtttgtcctatatggcttttattactttgaggtaagtcccttctatgcctaatttgttgaaggtatttattataaagcattgctgcatattatcaaatactttttctgcatccattgagatgattatgtggcttttgtttttaaatctgtttatgtgatgtattccatttattgacttgcatatgttaaaacatccctgtatccctgggatgaaactcacttgaccaggatgtattatctttttgaggtgctattggagtcagttagctagtattttgttgagaatttttgcatctctgttcatcagggatattagtctgtagatttttttgttttttgttatgtcatttattagtctgtagttttgttgttgttgttatatcattttctagatactggcttcacagaatgatttaggaagaattccctctttctttatttttgggaatcatttcagtgggaataattgatactaattattctctgagtgtgtggtataattcagctctgaattcttctggacctgtatattttgttgttggtggtaatttctttaatttctaattcaatcccactgttactggtctgttcagggtttctacttcttcctgatttaatctagaagggttttatgcttccaggaatttatctatttcctctaaattttttagttgtgtgtgtaacagtgatcatagtagccttgaataattttttggatttctctggtattggttgtaatacctcctgcttcattcctaattaagcttgtttggatattctctcttattttcttggttaatctcactaatggtctattaattttgtttatcttttcaaaaaaccagctttttatttcatttcacttaccttttgtattttttgttgtaatttcatttagttctgctctgatccttcctatttctttctttctgatggctttgggtttagtttgttcttgtttctagtgtttcttgagttgtgacaatatagattgtcaatttgtgctctttcagcctttttgatgtaggcatttaatgctatgaaccttagtcttagcactacttttgctgtttcccagaaattttgatcactctgtcactattatcattcattttaaataatttattaatttccatcttgatttttacccaaaaatcattgaagagcaaattacttagttttcatgtatttatatagctttgagggttctttttggagttgatttccagttttacttcactatggtctaagaagatacttgatatgattttgattttcctgattttacagagaacaattttactgatttatttatcagatctaacaatttttaaatgaaatccttgggtttttctagatattatactatgtcaaatgcaatgaagaataacttgacttatttatttccaatttgaatgcactttattttattattattattttttgctcctaattgcactaacaacatcttctggtattatgttatataagaggactgacagtgggcatctttctcttgttccagtccctaggaaacattctttaatttttttcttgttcagtatgattttagtcatggatcatatatggcctttatcattttggagaatgtttcctctaaagtcattttgatggtttggtgatctaaaaccattataatttattatatagggatttggatttttatgggctttttttagcatgtactgaaataatcctataattcttggatctgttaatacggtgggtcatgtttactgatttgcatgtattgaaacatccttccctcctcccttgcacgaattctgtgttaccctagaaaattatcttcttaatgtattattagtttggtttgcttgtattttttgaggacttttgcatctacacttgtattagtccattttgacactgctaataaagacatacctgagactgggaagaaaaagcggtttaattggacttagagttccacatggctggggaggcctcagaatcataacggaaggtgaaaggcatttcttacatagtggcggcaagagaaaatgatgaagacgtacgagcggaaatctctgataaaatcatcagagctcatgagacttattcaataccacaggaatggtatgggtgaaactgccccgtgattcaaattaactctcaccacgtccctcccacaaaaatgtggaacttttgggagtacaattcaagacgagatttgggtggggacacagagccaaaccgtataattctacccctggcccctccaaatctcatgtcctcacatttcaaaacctatcatgccttccccaatattcctcaaagtcttaaatcatttcagcattaacccaaaagtccacagttcaaagtcttatctgaggcaagacaagtcccttccacatatgagcctgtaaaatcaaaagcaagctagttacttcctagatacaatggggttactgatattgggtaaatatagccattccaaatgggagaaattggccaaaataaaggggttacaggacccattcaagtccaaaatccaccagggcagtaaaaatttaaagttccaaaatgatatcctttgactccaggtctcatatccaggtcatgctgatgcaagaggaggattccaatggtcttgggcagttcagtccctgtggccttgcagggtacagcctccaccctggctgctttcatgggctggcaatgagtgtctatggcttttccagttgcatggtccaagatgtttgtgcatgtatcattctggggtctggaggatggtggccttcttcttgctgctccaataagcagtgccctggtggggactctctgtgggggctcacagcacacattttcctttcacactgccttagcagagtttttccatgatggtctcacccctgtagcaaacttctgcctggacattcaggagtttccgtacatcttctaaaatcaaggtggaggttcccaaaccccaatttttgacatccatgtactgcaggctccataccatgtggaagctgccaaggtttgaggcttccaccctctgaagccatggtctgagttctacattggcccatttcagccacggctggagtggctgagatgaaaggcaccaagtctctagactgcacacagcatgtggaccctgagccctgcctaggaaaccatttttttctcctagacctctgggtctgtgatgggagaggctgctgcaaaggtctctgacattcctggaagacattttccccattgtcttgaggattaacattcagcttttcattactaatgcaaatacatgcagccagtttgaatttctcctcagaaaataagattttcttttctattgcattattaggctgcaaattttccaaacttttatgctctgctttcctttcaaaaaggaatgcatttaacagcacccaagtcacctcttgaatgctttgctgcttagaaatttcttctgtcagataccctaaatcatctctctcaagttcaaagtttcacaaatctctagcccggggcaaaatgccacccgtctctttactaaaacataacaagaatcacctctgctctagttcctaacaagttcctcatctctatctaagacaacctgagcctggatttcattgtccataccatttccaatacttttgtcaaagtcattcaacaagtctctatgaaattccaaactttctctcatttttctgtcttcttctgagccctccaaactgttccaatctttgcctattacccagttccaaagtcgcttctacatttttgggtatcttttcagcaatgccccaccctactagtaccaatttactctatttttctgttttcacactgttgataaagacaaaccagatactgtgaagaaaaagaggcttggccaggcgtggtgactcacacctgtaatcccagcactttgggaggccaagacgtgcagatcatgaggtcaggagattgaaaccatcctggctaacacggtgaaaccccatctctactcaaaatacaaaaaattagccagacgccttggtgggcacctgtagtcccagctactcgggaggctgaggcaggagaatgccatgaacccggggggcagagtttgcagtgagccgtgatcgcgccactgcactccaacctgggggacagagcgagactctgtctcaaaaaaaaaaaaaaaagaaaagaaagaaaaggaggcttaattagacttaaagttcctcatggctggggaggcctcagaatcagagcaggaggtgaatggcacttcttacatggtagcagcaacagaaaatgtggaagatgcaaaagtggaaaccccagataaaaccatcagatctcatgagactcattcactataatgagaacagtatggaagaaacagtccccgtgattcaaattaactcccatagggtccctcacacaacacatggaaattatgggagtacaattcaagatgatatttgggtggggacacagagccaaaccatatcaatactcatcagtgatactggcttgtagttttattgttttgttatgcccatgctttgtttttgtgtaagagtaacattatcctcatagaatgagtttgaattattcccttttttttttatttctctttttcttttcttttttttttttgaaaaggttgagtcagattggtatcaagctgttacatgttgggtataattcaaaagtgggatcataagtttctgaacctttttattttgatgaaagacattttattacttcaataacagcttcaatcccttgcccattattatttgtttgatgttttcaaccgctttatagttcaatcttagtaagttttgagtccagaaattcatatatttcttctaggtttactattaatttatcataacaattctaatagttttgtattattttggtctcagtttttatgtctcttctttttccatttctgatggtttttatttgcatcttgtctatgtttttcttgcttaacttagctaaaggtttgttaacatcattgatctttgaaacaagtcagggtcactggtctggttgtctaaggtgttatcagagcttgtgatctcaggaccaaaaaaattaagaagcgtggttacaaagggtgaggttggagcaaaaatttaataacaaaaaaacaaagctctcggcagtggagagggttccctgatggttgctgtgttacggttgtattcaaaagctcttatgaggaactgctttcatctctgtaactgagtaacttttcttatctataaaactgcctgcatagtttcatctctgtaactgagtaacttttcttatctataaaaccgcctgcatatctcccagttattctctgtcattgtggatatgtctccaggaaagcacaaagtgctgtttcttgcgtttgtataatgatgggtttgttttaggtacacccccctcctctctttgcaaattcccatggagcccactgtgtacatgtctgaaaaggggaggacactttttcctgggagcttactaatcatacaaagagcaaagggtttctatgctggacattgcatgccttgcctgcttatctgtggcttatctgtgcaggtgcactgtagctgtgattttttttttaggcaggcagcttctgcagtctgagtttttccccaagctgctctatttttcctgtagttgtgagttttcaggaaggcagcatttttgaggaccagccttaattgtttacttaactgattttctcttttcttctccatcatcttcacaaaaaaacaactttttgtttcatagatcttttgtattgtgtttattttagcctcaaatttatttaactgtgttctggtctttataatttctttctttctattagctttgggtttggtttgttcctgcttttttagttctttgatgtataggattaggttatttgaagtctttcaacttttttgatacagatgtttgttacaagaaactttcttcttacagtttttttggccatcttccatagatgttggtatgctgtacttccattttcatttgtctcacaaaatttttaaattttcttcttaataacttcattgacatgtttgtcatttagcagtatgtttaatttccatgtgttcatgtctgttttccagattcttcttttaatttattttttgttttatttcattgtggtcagaaaatatacttcatatgatacttgtgtttttgaatttgtacaggcttgtttggtagcctatcatagaattaagggagacattttttgtgctaataaaaagaatgtctattctacagcaattatgtgaaactttctgtatatgtcagttaggcccttcatatctagtgtgtactttaactctgatgtttctgtgttgattttcttcctggataatctttccattacagagaatggggtgttaaagtctcctactattgctgtgttgcatgctagttttgcctttaggtctgttaatgtttgctttacatgcttgagagctcaggttttggtaagtataatgactaaatcttgctaaactgaccccttcattatcatgtagttactgtctttgttttttgttttttttttcccgtctgatttgtaatctgtttataactacacctgtacttttctggtttctagttgcatggaatatattttgccatcccttcactttcagtctatgtatggctttataagtgaagtgggtttctttaaggcagcatgattctttattcagccattctatgtcttttaactgagaactgagacaatttacatccatttttattattgacaagtaaggcttactagagccattttgttgattgtttactgtttgtttttagactcctctcttccttccttcctgtctttcttcataattaggtgattgtctctggtagtatatttcaagttgctgctttttaagtacatcaatgatagatttcttaactgtggttaccagtagacttacagaaaaccattttagagatatggcatgttattttaaagagatcacaacttagattgcaaataaaattataaaataaataagggcaaaagtcacagaaaatgtatatactttaactcaatcacctacccattttgactcatagttatcttgatttacatatttgtatatcatctgtttcttaaccggttgctatagttgttatgttttctgggataggtgaaatgcagaacacaaattcagtactagcttattctgggtttttgcatgtactcaattttaccacttgtttttataccttgaaaagttactttttgcatgatagtgttttactctttctgactgaagagctcccattagcattttttgcaagatgggtctggtggtggagtctcaggacttttccttagttcagctaaagatgggatccttgtctgtcccatggccacaaaaatttaggctcacagatggtttgaatgtcgaggactctgaaaggccagagtccccctgctagagtgcttcctgctcaaagcttgaatcccagcttccacacagaaagaggaggggcctggctcttccccactgcaaatggcacaaacttgctgaggttccaccccagtgaacatttttctcagtgttcaagctctttggagattctctggggaccacctcctacctggctgtctctttcccccttgtaaagaagtacatctgaatgctatttgaaagagcataaggaagatcaatctttactgcttcctgctgacaaggggtgctgtttttgggaaatggtggtcagagctcactcacaggcctatctaagagttcccccagcagaaagggccattgtcagagactctgcttgcattattgtttggagtttgatgccctgaaggcaagaacagacaaactaggttattagaaaacatgtatcaaaatgaaacaaggggaggagtaaggatagctcaaaaattctgaggccttttatcactttgcacagggagagaaaggccaaaagccagactggtaaaatacccttttgctggcatgttggtcttctgggttcccttcttctgggcccaatctttagccaaccagcttaaggtttggaaagttaactctttccagtttggaagatgcatctgaggggaatgtcccagaatacggagacataattacctatccgtgaagagagaacagaggagaagaaaggaaaaagaaggcaccttttaaagaagtcccagggggtcatgatgcattcaaaatgggtacagactgaaggtgaatggctactcacctaggaagagggtggcaggtgtccctagttctcttctctttctagcagatacctggggtacatgagggagaaagagcatcctcttttcttcttccgtccttgcttccccgagtgctggtaaccttggtatgtgctgaaacaggtgtcaaagcaacatgcacccatgaaccagtggggcctagggggtgagaacattcactcttacccacttacccacatacaccctatctcccctgctttcagtagtctgggagtccctagacctcatctatgccatggatactaacaaggcttttatccatgaaccagggagcttgggcttcacttaattggcaggaaacagccacactcacctgcactgtgcattttgttgcacaaagtaggggcttatcctgccttagggactgactctttttcaggtttgatatctgcatgttttccttggcctggctcttataaaaccccacccaggaactgggttttctcctgcctgtctgcgtgtgtgttatgtgtaatgtctgcagaaagagctctaaatgattttggcctgaaaaagacaaacacttgcatctaatattttttaaagagaagttaaaaactgtggtaccgttcagttcacgtgactttaatctttgagaaataggaagaggcttaaagattaatggtaaaaagcagatgtcattacagtgtaaataggtggactaaataacgcaatggtgtctttgtccatctcagggccatgaaaatttaggctggcagatggttcaacaggtgagtaaagcagggttttattgggtgaaaaggaaaaaaaaaggggaaacagggatcttccacaaggctggagacccctgccagagtgcttcccactagcagcttgaatcccaggttccacatgggatatttgccgggctcctccctgttgcaaacagtgcaaaattcctgaggttccaccccagtgcacattcctcccagtgcacaggcttgttggagattctctggggacctccttctcctctgactagctcagtggtcaattctatgttttgtttgcctggtaaatacttcatctctcatttatatttgattgataattatttttgtttcaatattttttggtggcatccttttgtgttgagcactttgaaaacatcattccagtccttcctggtctgtatagtttcttttgggaagtctatctccataaatattggcgctgttttatatgttatttgctttcacttgctgatttcaatcttttttctttaatgtatttttttttgtcctttgtgactttgattattttgttaattggggtagtcttatttgggtttgcattgtgttctaagacctttctgtacctggacattttatgtttctcaagttttgaaaagttttttgttactatttttttgaatgagcgttctacccttgctcttactcacatctctcttgaacaccaataattcttagactgggtcttttgaagtaattttctatattttgtaggtggcacttgcttttttattctctcttgactttttaaaaataaaataacgagtcttagagctcacagattcttttctgggcttggatcattctgtggtttaagacctctaatggattttgaattcagcaaatgcatttcttagttccaagatttctgattgatttctttgtattattttaacctttttgttaaatttctcggataaatttctgaaataacttcctgtgttaacttagacattactaagttttcttaaaactgctattttgtattctgggtcagagagctcagaaattgggttatcttattagtgtcaatcactagatttttgcattgtccttttggagaggtcctggttccctgttctctgttgtttcttgtgaatatatgcatgcctttgcattgaaggattatttgttccattttttttctgtctttttttaatggaatatatttgcttagaaaatctttaccgaaaagtcactgcattcactttagttctaggtgacatgttaagcccaggtttacctcagctcatgtgaatgattagagctctgcctgtcccaagtgatgggggttccaaatggattatcctggaagtgtgagaacactgcctaagggcttgttcccagtatacctaaagaacttacatcctacagcatgctgttgctaagcaactactctgatttgaggtcaatttttggctgagttacggagaagagtttccatgtctaagaggttggtagtcctgcctctcttttttgtctctgcctgtcctcaggaatgtttctcccttcatgcactcataacatttccactgggttaaggaaagacaggtctaccagggaacttgataagatggggaagcttagtgaccatatcagtttgtctttctctcatttatataaaaattacttgacattgagtaatttataaagtaaagaggcttaattgcctcacattctgtatgctatacaggaagcatagtggcttctacctctcaggaggcctcaggaagcttgcaatcatagtggaaggcaaaagggcagtcaacacctcatatggccagagcaagaggaagggagttgtaggaggtgctacacacttttaaacaaacagatctcttgagaatgctgttacaagaacagcaccaaagggatagtgctgaatcattcatgaaagatccacctgatgatccaatcacctcccagaaaacccatctccaacactggtgattacaactgaaaatgagatttgggtggggacacagatccaaatcatattgtaaatcatgaattggagatagatattctgcgtttttggtgcagagcagagttgcaagttaggggcattattaatgtagacatagacatataattcccctacgtagtgtctactcagactttttctacttttatgacactgggaaatgtgttatcctcttaattaagcttttggttgttgtggtgtagatctcagtgccatatgtttgttttgttttgttttgcatgaagaaaaaaaggctgcttgtctctactctgccattttggaaccagaagtctcttgctccgtatattcttaataaacgtttcttatcagatatatgaattagaactttttaaattctacttatcatcagtacacttttttgatggtgtcctttcaagaacaaacatattcatttataagaatatcagtttatccattttaacttagttttttgtgactttgttgccttgtcctagaaaccattgccaaattgaagatagaaaagatttactttttctattctgggttttgtacttctgtttgttaactttgggttgttgatgtattttaaattagttctttatgtgttgtcagagaaagtgtatcttgtttttttggcctttggataatcagtctcccagaagtatttgtggaaaatattgttgttttcctattcaatagtttgacgtctttctcaaaaattaagtcaccactgtgtaaaaggatttctggattctaaaatctgttccatttatttatatggtgatctgtgttcctgtgtcacactcttataactattgatgatatgttgttggttgaaaatcggaaatgcaaggactaaattatttttcaaaatattactggttattgagattgtgccactgcactccagcctggccacagagcaagactctgtctcaaaaaaattatacatatatatatatatatatatatatatatatatatattgtgtgtgtgtatatatatatagtgtgtatatatatagtgtgtatatatatagtatatatacacacacacacgtatgtgtatgtgtgtatatatatatatatatctcgctattttttggtctcctgtatatctatattaatttagaatgagcatgtttatttctgtaaagaacccagctgggaatttaatatggattttggttaatttgtttattaattaagattttcaattgaggaatatgagattttatttattcattaagaattttattcctcaatatttagtaacttttacaatttaagttttaagtttcgcaatttattttatttttttgagatggagtctcattctgtcacccaggttggagtataatggtgccatctcagctcactacaacctccacctcccaggttcaagtgattctcctgcttcagcctcccaagtagctgggattacaggctcacgccaccacgcctggctaattttttatatctttagtagagctggggcttcaccatgttggccaggctggtctcgaacttctgacctcatggtctgcccgcctcggcctcccaaagtgctgggactacaggcatgagccactgcacctggcctaagttttgcaattcttttaatgtttttcctgtttttttaaaataatttttgattatattttatgtaggatttttgaacatgttattttcttctgtattgttcaattatgtaacaatacaattaatatttgaaggttgaccgttagtcctaaaaatgtgcttattttgttgttgatctaatattttctaggaaagtctaagatattctttacataaggtcatgccttttgtcaacaaagagagtgtacttatttcttaccttctaataaggattatttttgttttgtgttacttcctatttgctttggctggaatctccaatataatgttgaatagaagtaataagaatgaatgtctagtcttttccttattttagaaaaaaatgagttaatcttcataataggtgtctccagacaaaaagagccatgtatgaatacacacacattagtacacacctatgagggaggattttattgtaggaatttgcttaggctgagaaatattatgatatacacttacacactttatatttaggaaagctgatgctgtaattcaatctgagactgaaggccttagaactaggagaaatagttgtgtaattatttgtctgaggatgatggccttagaacttaaggagctacaagtggggtttactagtgcaaaccctagtgtccaatggcccaatatccagaagcctcaaataaagaaggcagaataatattaatgtcccagccaaagaaaagagaaatatttgtcttcttctgccttttgctctatttgggttcttaacggattggatgatacctgcccacaatcatgagagatatctttagtcagtctactgatttaaatactaatctctttttaaagtattgtaacgtttgtcacagaatcataaaaatatctatcctaaaattcatacaaaccccaaaatagccaaataaatcataaactaaaagaagaaagccagaggcatcaaattacctaatttcaaaggatattaaaagcctgtagtaactaaaacagcatggtagtagtacaaaaacagagacatagagcaatggaacagaatagagaaccaaataataaagccacacacctactgccacctgatttttaatgaagtcaggaataacaagcaatgaagaaagaaccctctattcaataaatgatgctgtgataattgtatagtcatatgcagaagactgaaatttgacctcttcctttcaccacatacagatatcaactcaaggtgtattaaatacttaaatgtaaaatctaagactatataaatatgagaagaaaacctcagaaataccatcctggatacaagccctggccaaagttttatgacaattaccccaaaaggaaattgtaacaaaaaaaaaattgacaagtgagacctaattaaactaaagaacttgtgcacagaaaaacattcaataacataaacagataacctacagaataggagaaaacatttcaatactatgcatccaacaaaggactaatgtttagaatctagaaggaacttaaacaaattaacaagcaaaaaagaaaaatcccactaaagagtggccaaaagagaacagacacttctcaagaataagtacacatggccaacaagcatatgaaaaaatactcaacattactaatcatcagagaaaagaaaatcataaaaaccactataagataccatcccccctagtcagaatgaatatcattaaaaagcacaaaatgacaggtgttggcaagattagggagaaaagaggatgctcatacactgttcgtgggaatgtaaattagttcagccactgtagaaagcagtttgaagatttttcaaataacctaaaatagaattaccattttacccatcaatcgcattactgggtatatacccaaaggactgtaagttgttctaccagaaagacacatgcacacctacgtttatcaacagcatcacagtactattcataatagcaaaaacatggaatcaatctatatgcccaacaatggtggcctggataaagaaaatatggtacacatataaatgatggaatactatgcagcaatgaaaaaaaaacaaaatcatgtctcttgagcaacacagatgcagctggaattcattaccctaggcaaattaccaccagaaaggaaaaccaaataccacatattctcagttgtaagtgggaactaaacattgagtacctatggacaaagagaaaggaataataggcaatgggaaatatgtgaaagtgtagaatgagagatctatgagaatcaaaaaactacctaccaggtactgtattaactatcttggtgatgaaataatttttacacaaaaaccctgtgacatgaaatttactcatgaagaagttgacactttaaccttctgaacctaaagtaaaatttagaggaggaaaaatgaaatgctctcacagataaatccagaaataattttttttttttttagctatttggtaatctcttaaaccagtcaagttgacacataaaattaaccatcatagttgtgcaattattttttgtggcatttatattgtgcaatatattttatggcattttcagtgcaattgtattattttatattggataattagaattatgtaaatatattgatttttatatatcaatcttttatcctgacaaggttatttatttgtttttgatctaatattttatactagatttattaagatattctctatgtaaagttgtatcatgtactgacatatgtaattgtattaacttctttttcaatatgcatgtttcttattttctgtcattgtctaattgccttagcttaaatatacaatggaatattgtcctaaaatgataaatagatctcttcatcttgttttttatcttaggtagtatttcactgatacacataataatagttttagacttttcatagctgtcttttatcagtttcatgacatttaacatcattctggttttattgaatatttttattttttattttaagtctatttctattttcagtttctgtcaattgcatatcatagttagtgtcttttgagagatttgctcattttattgagttatatgatttgttggtatgcatttgctcctagcaatgtactgtaatattttgtatttctgtatagtgtgtagtaatgtgtagtctttcatatctgattttaataatgggagtcttctcttttatgagaggtaagtctacataaatactctttgttttatttaattttgttaatcttttgaatgtaccaaattttggttttatttcctttgttgtttttattctttcatttgcttattttagcaataatcactatttcttttcttctgctttggggggtttgttcattttttctagttccttaaagtataaaattgcatattaattaaaaatttttgtctaattaatgtaggcattttaaggtcataaattgtcctctaaatattgctttttaataaattttggtgtatttgtttttaatattcttaaactttgttctgttttcttttgattttatctttgttattttgaattatgttgtttaatgtgtaatcatttgtgaatttctcaattttttaaaactgctgacattgaaggttattcctttgtattttcagaaaataacacatactatttcaatcctcttaaacttattgaggcttttccggtcaagtgatgatttgttttggaaatattaatatgcacttgataatattaaatatgtagctgctttttggagtgtgttatagttgtgtgttagagctagaagatttatagtgttcttctagtattctatttccttgttgatctttttttaaatttttgtgtatttttaagagtgaaatagagggggtgggccaagatggctgattagaagcagcagtggtccatggctctcatggagaagaatgaaaacagtgaataaattctgcaacttcaactgaggaattaaggttctcaaattgggactgacttagcagttggcacaactcagagagtgagaaaaagcggagtgggatgacagcccaccccagagtgccacaagccaggggagtccctacccccagccaaaggaggtatctctactggtgatacctccaggtgtgtgagagaccgaggctgttgctgtcagttgctatgggattgggtgaagggggatgaatggagaaatgaagacaaagacaaaaagatctgttttaaaagaaggtgtcaggggctccttgcttctagtgaacaaaggctttgagcttctacagcccttcatatttattaggtgaaaagagcagggaggaagaggtaatggttggtcagctgcttgatttatcacaggtacacataatttctttctttgtacaacaggcttcagatattcctacagataatcacaaggaacactgtgcttggggtgtgattgccctcagcactccttctgggggcagacatagtcatcagttttccaacatcctgctttcatgagaacagttttctgtttgctcatatagcctccagtggtatgctgagttggtcacgaccctcattcttttggcctgtaacatctccctctttttgttttttcattaattgaataaaggtaattgcaggttctgcagctctcaattgccatttggtggtccacctgattttgaagactatgaacaaaaaacagaaacataataacattaatccaatagtaacaacaaagacattgagttgctgtttgcggtaggtccaagggttaaggctctctaaaccttgttggaattctgcccaagcttttaaacagggctgaaacacttgagtttgcttatcgaagttaaggattttactttgtaaatcattaatatcaaaagtaacattggatgtgaaagctccctgtaaatgggcctttacaaggctccaggaatattcactttggttatattccaaattggtcacacaaatatgagtatgattaaaatgacaatgcaattgctgatgcaactgcaaactttgttatttgttctcctagccaaagaacagtagcctttaacattgccacctctgttcatatttcagcgttaattttattttgaagcatccatgcctggccagctgtgcgtgtccaattttctacatattgagctgtttgaatagagcgatgcattgctactgaggacatcacaacagaggttatcaatgtaactaaggagactatagcaacaattatcatgcctaaggctctacgagcacgatgagtaagctgagtaaaaaagagttttataagatgtaaaatgggggtggccacccaaggttcagacagatttacaggaatccataatctgggaatgcaacctagaattattagggtggatatatcatgtgtctgtattgtgctttgattaaggcaatgataaagttgacaggaatcacaagtcgactgggcatcatccacctggagttggtccttttttgctactaagaaaacgtaagaattaaagcacaaattataaattgagtggtaatattttctaccatgatcatattaaaactgcatttagcactgttattattattgaataatgtcccaactcaaatgctgccattaataaatgggagtgctgttttgcatatcgaattctggattggacctctctttccttgagaatgccattgaggcaaaggtgggctaaggcctgcgccatgccaagtaatttgcgcagcagattcggattgaatcccaatgtgacgtggcaaagagatgttaaagttttgccaccagtggcagtgaagttcatgccatgaggtctgatgctcatctctcccaaccaagtgaccatggggaccccagtcaataatgtctcccatcagcatggactgttgtctagctagggagccaagacactgggtccaaggaggggagttagaattatcaaagggaacccattctgtataattaatacaatttgggcgatgagaccaggagtgattagtaactgcactagaaatattaatagagctgaggcccaataggcacaaatattttcttttttttactattatactttacgttctagggtacatttgcacaacgtgcaggtttgttacatatgtatacatgtgccatgttggtgagctgcacccattaactcatcatttacattaggtatatctcctaatgctttccttcccccctccccccaccccatgacaggccccagtgtgtgatgttccccttcctgtgtccaagtgttctcattgttcaattcccacctatgagtgagaacatgaggtgtctggttttttgtccttgcgacagtttgctgagaatgatggtttccagcctcatccatgtccttataaaagacatgaactcatccctttttatggctgcatagtattccatggtgtatatgtgccacattttcttaatccagtctatcattgatggacatttggggtggttccaagtctttgctatcgtgaatagtgttgcaataaacatacgtgtgcatgtgaggaaagacaattttgaaaccaaagtttgattttggaaagcctttttagtatatttaaagcatttgatattgtaaaacagaattccaaattactataagtcatttattttgccaaaatgatgactcagaaacgttaaagaagcaaaaaccttttataactcttttgaatttagttaatatattcacatagataacctattctgcaagattaattttcagaatttttctaccacttgtttgaaacttcagctttttcctaatttgaaaagccaggtgtcaggaaagacaattttttaaattatactttaaattctagggtacatgtgcacaatgtgcaggtttgttacatttgtatacatggttgcgtggcacatatattttctatggtaactcaatcatgcctgggattaaattgcaaggaaactgcagttgagtgatgtatcctgggtgatgcataaaggaagtccctccaatggagcagtataattgataccattgtcctgagagtctaattgctctgtgtcagggggagttaagggtcctggtgcccatactccttgatcatgatataactcaggaggattgccagtccagagtaccggtcatactactgggaggttaagaacatatgcccaatatgtttttgcctctgcacagggaaaacatactgcacaggatattacagctgacatggccataaacttggagttaggggtttttgcctcaccctgatgctctagcagtttctcagctttttgtgtggttttcttgatctgtccccatgtctttgcattcagattcaactggctcatggctcatattggaggagctgggcccatggttgggatccatgggtccctccagtctcccattccatggtcacatacatggtgggggaacccacacagtttgtccatgtcctgtaaaaacataagcataccctcatccccacgttagtaaatctactgggcctttccattgcccttcttctggggacttctataatacctttaggtaaacttttttccctttaacatttgccactgtcattctgccggagtcttattatctgtaacaggagctaaaaaatttaaagtaaataaggctaaatgtaattttatttgaggtggtagctggtctcctactccccctttttgtttttttcaacatacactgtatgttagttacatcaattacattaataaatgtaatgcatgtttgatgtgccagctctataatgccttgtcctcagggattgtaaggaattcctgtcttatgagtaatttcccataactataaaaaattttgaaaagcatgactaacataagcaggtccattgtcagattttattggtttaggaacacccatatgggcgaatgacaataaacaatgccgctgtacatggccagctctttctgtttgacacgtagcatgtaacatatgagagtaagtgtctacagtcacatgaacacagctaagcttgccaaaggctgctatatgtgtaatacccatttgccagatttcatttggagctaagcctcgtgggttacatccttttatgggtatatcaccagggacatactggcaagtgggacaggcttgcacaatagctcgagcctggctacgaggcagatgaaacatacaagtaagggtgaggtgttttgatgcaataatgtatgaaaggcttgagcttgctgaaacacagagtcaatcaatttatctgctttgtcattgcctacagatagtggtccaggaagttgtgcgtgagagtgaatatgagaaatatgtaaaggagcagcataagaatgaataacttgctgaagtcttagaaacaagttaaacagctctggttctagggtgcttttaatagtggcagtctcaatgtgactggctacatttacaacataggctgaatcacagacaacgttaataggagttgaagcagtgagctgtaaaacctcaataactgccattaattctgagtgttgagctgaaactccagaggtttttattgtttgagtatgcttaggtccataaatagctgctcagcctttggaagagccatcagtgaaataagtctggccacctggaataggcttgtgataagtaatcacagggaggataaaagggtgaactttacaaaattgcaaaacttgcctgatggatagtggttgtctattattactacaaaatccacaagagcaatttgccaagcagtcaacatttcccatgctgcagcctgttgttggaaatccaagggaacaataattttgtctgggtcatatcctgtaaacatttttgatctatgcctatccatagttataagttgagtaattaaagaaagataaacttgtaaagattttactgtttgattggatagaaaaagccattctattaccattacaaacttgtctataaatgggcccaaaattcctattggagagtagggggttggaagaataaacagaagcaaaggcttttgtggctgtagccaggaggcatgtcttcactgaagcatttgttctacaagctgtaattcagcttctgcctccttagtaagttgccaaggagagtctaatgaagaatctccttggagggtctgataaaggtgtttgagtcgataagtagcaatacctatcatcaggcgcagccaattaatatcccctaacaattgttggaaatctttcagtgtttgtaatctgtccctacggagagttactttctgaagtcgaacacttctttcagtaacaatagtgcttaagtaccgatgtggggaggttgtttgcaccttttctggagctattttgagattccatttaatcaaagcctgttttgtttctctgaataactgatgtaaaatttgatctgtaggagtggccaaaagaatatcctccatataatgaacgatgtaagcagtaggaaacatattccgaggctcctttaatgcctgtcctacaaaatgctgacatagcacaggactgttaagcatgctttgtggtaaaactttccattgataatgagaaccaggttgtctttgatggatagaaagcacagagaaggcaaatcgaggcttatccttctcgtggaagggtatagtacagaaataatctttaagatctattactaagagaggccagtccattaaaatggctgccgcggatgccagaccttgctgtaatgcgcccattggtttaatttgtgcattaatgactcttttggaattgcaaatactggtgaattccagggactaactgactcttcgatatgttctgcatccaattgctcttttactagctgatagagttgagttagtttctcctgtgataggggccattgattcatagaggcatgggtgggacaacagattcttttaaatttttagactcagaacatgactcctgctgtccagcagaataaggagataatggcagacagacagtaagaaacaaactccaagtggagaaatcagaagggtcaactttaagacctttttgatgagctcgttttaatccttctcctattctgttccaaatttccacatcgagagtgcccatctgtggaaaccatgggttatgtacagtgaccttcttcagcatcttagttaatgtttgagaactaacctgagcaccagattgtttaagtaaaactttaagcaactgcacataatgttgctcctgaatagatagattctgccccatgttaccctgattcagaaaacttcccattcccagtacctctttagggcactaaccttatattagctgccagtagacttgtcccaaggtttcttgctcatctggtcagtttcactttctctgctccagcagaccttctttgctcatgtccctgtcctgggcaccacttgtcactgccagttgctacaggattgaatgaagggggatgaatggagaaatgaagacagagacagaaagatctgttttaaaagaaggtgacagggggctccttgtttctagtgaacaagggatctaagcttctacagcccttcgtatttataaggtagaaataggagggagggagaggtaatggttggtcagctgcttgatttatcacaggtacacttaattgctttctttgtacaacaggcttcagatacttctataggtaatcacaaggaacactgtgcttggggtgtgactgccctcagcactctttctgggggcagacacagtcatcagttttccaaatcctgctttcatgagaacagttttctgtttgctccagtggtatactgagttggtcaggaccctcattctttcagcctgtaacagagggtattagagtctggattgaaccgtagcaaacagcagtagccctatagaaggagggcttgactgttaaaagaaaaacaaacaaatagaaagctacagcaacaacatgaacaaaaaaaaaaaaaacgcccataaaaaacccgttcaaaggtcagcaacctcaacaaagttgagaaagaatcaatgcaaaaacgttgaaaatttaaaaagccagagtgcctcttcttgaaatgattgaaacaactctccagcaagggcacctaacttagccaagtctgagatggctgaatttacaaaagtcagcttcagaaggttggtaataacaaactacactgagctaaaggagcatgttataaaacaagacaaagaagctgagaatcataataaaacaatacagggctggacacagtggctaacacctgcaatccaagcaccttgggaggctgaggcagccagatcctgaggtcaggagattgagatgatcctggccaacatggtgaaaggctgtctctactaaaacacaaaaaattaaccaggtgtggtggtgcacacctgtagtctcagctactcagaaggctgaagcaggggaatcacttgaacccatgaggtggacattgcagtgagctgagatcatgccactacactccagcctggtgacagagcaagactccatctcaagaaaaatttacaggagctcaaacccagaattgctcatttaaagaggaacataaatgacccgatgaagctgagaaacacaacatgagaacttcacgacacaataacaagtattgatagccaaataaaccaagcagaggaacgaatctcagagtgtgcagactatttttctgaaataagacaggcagacaaaaatagaggagaaaagaatgaaaaggaatcaacaaaacctctgagaactatggctctatataaaaatacctatgattgattggggtacctgaaagagatagggatagtggaaccaagtttgaaagcatactttgagatataatccaggagaatgtccccaacttagcaatacagggcaacatttgaattcagaaaatccagagaaccccagcaggatgctccatgagaaaatcaacctcaagacacataatcatcagattctccaaggtcacaatgaaagaaaagtgttaagagcagccagagagaaaggccaggtcacctacaaaggaaagcccatcagactaacaacctgtcattggaaaccctacaaaccacaagatatttgggaccaatattcaacattcttaaagaagagaatttgtaacccagaatttcataaccagacacactaagctgtataagtgaaagggaaatcatattcctttcagacaagcaaatgctgaggaaattcatcaccaccaagcttgcctttcaagaactcctgagggaactactaactattgaaaggaaataccgttaccagtgactacaaaaaacacaccaaggtacacagactagtaacactataaaacaaccatgtaaacaagtctgcaaaatagccatcatgatgacaggatgaaattgacacaatattaaccataaatgtaaatggacttaacgcctcaattaaaaacacagaatggcaagctggataaagagtcaagctccatcagtatgttgtcttcaagagacctatttcacatgaaaagacacacataggctcaaaataaagggatggaggaaaatttaccaagcagaggaaaacagaaaaaaagcagtagttacaatttttgttcctgacaaaacagattttaaaccaacaaatattaaaaaaaagacattacatgatgatgagttttcaattcaacaaaaaagctaattattctaaatatatgtgtacccaataaagaagcatccagattcataaagccagttcttagagacctccaaaatgacttagactcccacacaataatagtggaagattttaacactccactgacaatattagacagatcattgagacagaaaattaacaaagattttcaggacctgaactcagctctggatcaagtagacctaatagatatctagagaactctccaactgaaaacaacagaatatacattcttctcatggctgcacggcacttactctaaaattgatcacattattggaaataaaacactcctcatcaaatgcaaaagaactgaaatcataacaaacagtctcccagaccacaatgcaaataaattataactcaacattaagaaactcaatcaaaatcacaagactatgtggaacttgtacaacatgctcctgaatgactcctgggtaaataataaaattacggcagaaattaggaagttctctgaaactaatgagaacaatgagacaacataccagaatctctcggatgcagcttaagcagtggtaagaggaaaagttagagcactaaatgccccatatcaaaaagctacaaatatctcaagtcaatgacctaacatcacaagtaaaagaactagaggaccaagaggaaaacttcccaaagctagcagaagacaagaaataaccaagatcagagcagaactgaatgagatagagacacacaaaatccttcaaaaaactcaagggattcaggagctgtatttttttttttttttgaataaaagttaacaaaatagaccgcatctgcactaataaagaagaaaacttaaaagaattaaatagacacagtcagaaatgataagggggatatcaccaatgaccccacaaatatacaaacaaccatcagagaatactttaaaaatctttagcacataaactagaaaatctagaagaaatggatacattcctggatgcacacaccctcccaagtctgaaccagggaaacattaaatccctgaataaaccaataataagttcaaaaattgaggcagtaataaatagcctaccaccaccaccaacaacaaaaatcccaggatcagatagacttacagctgaattctaacagagatactatttcttctgaaactattccaaatgatcgtaaaggagggactccaacatcaacaacaacaacaacgacaaaacttcaggccaatatccctgatgaatatcaaagcaaaaatcctctaaaatactgacaaaccaaatccagcaacacatcaataagtttatctatcacaatcaagatgacttcatcctcagaatacaagtttggttcaatgtacaaaaatcaataaatgttattcatcacataaacagatctaaagacaaaaaacacatgattatctcaatagatgcagaaaaggcctttcataaaattcagcatttcttcacattaaaaactctaaattaactaggcattaaaggaacatacctcaaaataataagagccatttatgataaatacacaaccaatatcatactgaatgggcaaaagctggaagcatttcccttgaaaaacagcccaaaaccacagtgccatctctcaccactcctattcaacattttattgaaagttttggtcaggtcaatcagttgtgagaaataaataaaagttattcaatcagaagagtggaagtaaaattatctttgtttgcagataacatgattctttatctagaaatcccattgtttcagtccaaaagcttcttaaactgagaagcaacttcattaatctcagaatacaaaatcaatgttcaaaaattggtagctttcctgtacaccaacaacaggcaagcaaagagccaaatagtaaataaacttccattcacaatagctaccatgaaaataaaatatctaagaattctactagcaagggaagtgaaggacttcttcaagaactacaaaccactgctcaaggaaatcagagaggacaccaacaaatggaaaaacattccttgatcatgggtaggaagaatcaatatcataaaaatggccacactgcccaaagtaatttatagattcaatgctgttctcattgaactaccattgacatgctttacagaattagaaaaaaaaaaaactattttaaaatgtataaggaactaaaaagtcagtagagccaagacaatcctaagcaaatagaataaagctggaggtatcatgctacctgacttcaaactatactacaaagctatagtaaccaaaacagcataatacttgtacaaaaacagacaggtagtccaatggagtagaacagagacctcagaaattacaccacacatctacaaccatctgatctttgacaaaccttgtaaaaacaatcagaaaagggtttactatttaatacatagctctgggagaactggctagttgtatgcagaaaattaaaactggaccacttcctaatactttatatgaaaactaactcaaggtggattaaagaattaaatgtaacaacaaaaactttaaaaaccctaaaagaaaatctaggtaataccattcaagtcttaggaacaagcaaagattttatgatgaaaacaccaaaagcaattacaacaaaagaaaaatggacaaatgggatctaattaaaggtctcctgcacagcaaaataaactatcatcagagtgaacagacaacatatagaaggagagaatatttttcccagttatgcatctgacaaagtacaatttcagttactttgctttatttgaaaatattttccctaaatcaaaatcttatcccttcctgaatatttgcaacattccttatatttctcacttttagaaagtatttatcttctaagtgcctactcctgaacttgttttgcagattgccttgtaattcaggcaagttgtattttgaaaaaaatctcaccagaaatttccatcaaagtagaattaagaaggaaaagatgcatgtgacaaaatagacaaacatgtttttattctattaatggtctgttaacctgcaatgaggtaaatctttcttaaaaggatattcaaacccagtttctgagaaaatattgcctgcagagtgtcaatattgttcaatgtttttattgtcgttgagtgcatgcattacgtgtcacccagattccccttttgggaatatagaaattactttccagctgatgaagtgatgaacaactgacatacctcacctataagctctctctctcagtacaaccctgctgaaagctatctagcatatagtgacctttccaagacagcccatatccaatgcctggtcacatgtaggactctaaaggcccattctccccttttcagtttggaccaactctgaaggcctaacagcttcagagctcccagtgggtgagacaaaagctatgctgagactgcatgtcttagcatgctcagggtgctatatagaaaaataccatacattggctagcttacagacaacaaacatttatttgtcacagttcttgaggctgaaagattcaccatcaagatgctggtattgggcattcctccaagatggcaactcgtcaccatgtcttaatgggggaaagagatgaatgagttattgtgagcatatttttcaaaagaattaattccattaatgaggactctgccttcatgacctaaacacctcctaaatggttctatcagctaatacagtaattttggttattataattataacttatgaattttgggggcattcagacattcagaccattgcactgaattatgtcctaatttgttccactgtccaatcctgcttcctactttttcacagatgttatttccaggaaaactctctaattatctccctcaaaaaatattcagcttagaatctacttcttcaaggcactgagcatttgataatatgtaccaagagaggtcagaaaaaaagaacagacaagaaaatgagattgtagagttggattattcactaccaagtgtaatgagaaccctatcactattggtacagagaacacaaatagcccctggaatgtgacaatttaaatttttcatacattcagtaatggtaaattatgatggaaatcttttgaggggaaaacattagttattaggatatatcacatatttatcaatatgggaacagtagaaattatgatcacaatacaggcaaatgtttttttccacagagttaaggcttgggagaaaataatagaagagtgaggactaataaccatcaaattaaggcaaatggtgaaagccagaaatgtctccttggaagtgttactggaaaaaggggtcttgatacagacatgaagtgaaggttcttggattccacacaggaaggaattcaaggtgagtcacagagtacagtgagaaaagatagtttattaaaagctatgacattacacagtagggcatcctcagaaggcaaggagttgaatgcaacacctttgttttaagtttttcttatatagaagtcttgtatctgtaaagattaattaagctgtatctagtcgtgggtggtcagacaacaggacaaaattgattattctatttattccaagaaaactatccttgacactttcctgtgtgaaaatatcaaaacatgactgttattatcttgaaagcatatatcgttatgaatattgggacatctggactcttcattgcagatgtgtgtgtttatagggagctgaacttaaaatcacattactctgactctcctacactcctgattccctaactgcagcatatacagagactctcacttcatgcagaagcacctggtccccatcaccaaatgaatctgaatcttaagtccaggactgaattttaaaaataagaccagttcagttctagctgaattcccagcctagtctgatcactaaccaggtttagggtctcagtttcgatacagtgaaattataagacatttgagaaataattcattgtagttaaaatcttcagtatctacactcccctgaactctgaatctgcaaaagtagtccattcctttctgttaagggatagcattttttcattgtttgaagatgatatagtgtcctcttccttgcaggacagtttatgtcccacctatgatttgtgcttggtatgatttcaattattttaagtcattcaggcttgcttcatgagaaagtttgttgttgatcttacaatatgttccatgtaaaaatgagtggaatgtatattacgtggttgtagggtggagtgttctgtagagctttaggtccaattggtcaagcatcaagtttaagtccagagtttctttgttaggtttttgcctcaataatctatctaatgctgtcaatgtggtgtcaactcctgccactattactgtatgattgggtaagtcttttcataggccaagaagtacttgttttataaatctgtctgcaccaatgttggatgagaacatattttggacaataaaaactgcttgttggattgtatcttttattattaggtaaagccattcattgtccttttaaatttttattcacttaaagtctgttttacataagaatagtaactccttctctttttcattttctgtttgcaggatagtttttactgtaccctttcatttcgaacctatggtataattacaggtaagatgggtctattgaatacaacatactcttgtgtctggcatatcagacactctatgtcttttaagtggtacgtttagcctgtgtacattcagtgagagtctctgtatatgctgcaaggatagtattaatatttgtgattttgatcctttcatggtgtgtttagctggttattatacagacatgactacgtagtttctttatagtgcctgtggactatgtgtttaagtgtgcttttgtggtagaaggggtaattcttttgaatctataagtagcatgcccttaaagacttcttacactgctggtctactagaaatatattctgtcggcatttgcttgccagagaagaatttttttttctctttccattagtaagtttagttcaggaggatacaaaattgttggttggaattccttttctttaaggacactgaaaacaggccccaagtctcttctggattataaacttccttgagaggtctgctgctagcttgatgggattaactctgtaggtgacctgctccttcttgaagactggttcttcaaatcaaccagtcatacaaaaataaagaaaaaaaaattaagaaaaataaagaaaacctctgagaaaatacaattatctaaaaagaccaaatctctgactcattgtctttcctgagagagaagtagagagaattagcaacttggagaatatatttgaggatatagtcaggtctactggggctcacttggggagaagtctggtaggacaacaggccacaccttcactgaaacaaccctgtggaggaacctacacaagcccgtgcatttgtgtgccccagctctccaagactgcagagagtgtagtctccttccttgttcaagtgatgagcatagccaccagcagtgcacttctaagctgcaggctacagccctggggcactgggaccctgtttgtagctcactgctgtggtcacttggggttggattttgggtgcagtgtaaaacctgaagggcttccaaagtgccagaatgcattcagatggagcaaagcactcaaactggcaaacagaggctgtactgtgtacaagcttctatggggcagccagagaggggccatggggttgagggttctggtgggccggtattcctgcagaacatatgtgtcacagttccatttgaaagtaggttctcctctctccccattggttagctaaggccagaacctattagaaatagatgtgcatggtatgtgggcacttatggttgggctccaccagaggtgacctatgcacaaaggtccctggctttttgtctgcagcttcatctctgtgtaatctctgggagacccctctgccagtccacatgtccctgaaggtatggagccccatctagccaggattccagatgtctacagtgagagggagctatctactagtcctttcactcaggtcttccctagaaactgttcagggcagagaatcagctgtattaaggcaccccattcagtgttctcagccttcttctgcttcagcctcagtgactattccttttctccatccacattcagcattttctctccaaagatctgttcaaattatgatgatatgataaaaaacctggtgttcccctggtggcagttgcacatcctgactgcatctagttgaccatcttgaacacatccctgtgtatatattcttttgagaattctctcttgatgtcccttgcccatttttttaatggagttgcttgtgtatggtttgtcaatttgtttaagttccttacagatttttgatattagacctttatcagatgagtagcttgcaattatattctcccattctgtaagtcatctgtttattctgttgatacttacttttgttgcacagaagctctttagttcaattatgttctattctcttgattttattctaggattttatacttttaggatactgtactagcctgttgtcatgctgttaataaagacatacctgagactggataatttataaaggaaagaggtttaatagattcacagttacacatggctggggtggcctcacaatcatgatgaaaggcaaatgagaagtaaagtcatgtattacatggaagcaggcaagggagcctgtgtagggaaactctcctttataaaactgtaagatctcaagagacttattcaccgtcatgagaatagcatgggaaagatgtgctaccatgattcaattaccactcaccaagttcttcccacaacatttgggaattatgggagctacaattcaagatgaaatttgggtgaggacacagccaagtcatatcattcttcccttggccccttccaaatatcaggtcctcacatttcaaaacaaatcatgcactcccatcagttccccaaagtcttagttgatttgagcattaactcaaaagtccacagtccaaagtctcatctgacataaggcaagtattttctgcctatgagtttaaaaatcaaaagcaagttagttactttctagatacaatgaggatacaggcattgggtaaataacactcctaaatggcagaaactggccgaaacataggggctacaggtcccatgcaagtccgaaatccaggtaaggcagtaaaatccaaggggcagtcacctccaaaatgatattctctgactccatgtctcacatacaggtcacactgatgtaagaggtaggctcccatggccttgggcagctcaacccctgtggctttgcagggtacagccctcctcttgggtgctttcatgggctggcattgagtgtctgtggcttttccagttgggtggtccaaactgtttgtggatatatcattctagggtctggaggatggtggccatcttctcccagctccactaggcagtgctctggtggggactctgtttgtgtgtgtgttggggtggggggctgcagggggttgctcacaccacacattttcctttcatactgccctagcagagtttctctgtgatggtctcatccctactgcaaacttctacctgaacatccaggcatttccatacatcttctgaaatctagacagaggttcccaagcctcaattattgatttctgtgtacccacaggctcaatcccacatcaaagctaataatctgccaaggcttgggggttgccccactgaaaccatggcttgaggtctaccttggccccttttagccacagctgggacacaggggaccgagtactgagactgcacaaagcagcaaggtgctgggcctggcctacaaaactattttttccttctaggcctcctagcctgtaatgggaaaggctgcagccaggaacacctctgacatgccatagagacatcttctccattgtcttggttattgacaattggtttctaattacttatgaaagtttctgcaacttgaatttctcctcagaaaatggggttttccttttatatcatatcaccaagctatgaattttccaaacttttatgctctgcctcccttttcaacataagttccaattccaaaccttatctttgtgaatatgtaaaacggaatgcttttgtctgtacccaagtcacctcttgaatactttgctgcttagaaatttcttccaccagatgccctaaatcatctctctcatgttaaaagtttcacaaatctctagggcaggaggaaagtgccaccaatctttgctaaaacataacacagtcacctttgccccagttaccaacaagttcgttatttccatctgagaccacctccgcctggactttattgtccatatcactatcagcattttggtgaaagcactcaacaagtctctagaaagtttcaaactttcacacatatttctgttttttcttctgagtcctctaaactgttccaacctctgcctgttacctagttccaaagttgcttccacattttctgatatctttacagcagtaccccactacctagtatcaatttactgtattagtctattcttatgctgttaataaagacatacccaaggctagttaatttataaaggaaagaggtttaatgggctcagagtttcacataaccaaggagacctcacaattatggcggaaggtgaatgaggagcaaagccacatcttacatggcagcaggtaagagaggttctataaactcccctttatagaacaattagatctcatgagacttatttactatcaccagaacaacatgtaaaagacccaccactatgattaaattacctcccactggatccctcccacaacacatgtaaattataggtgctacaattcaagatgagatttgggtggggacacagccaaagcatatcagttaaacatttacatctttaacccatcttcagttggtttttgcgtatggtaaaaagaagatatctagattcagtcttctgcatatggccagccagttatttcagcaccttttgttgaatagtgagttgtttctccattgcttgttcttattgactttgtttaaatcagatgactgtaggtgtactgctttatgtctgagttctttaactggttccattggtctatgtgtctatttttgtaccagaaccatgctgtttcagttactgtagccttgtattatagtttgaagttgggtattgtaagcctctggttttgttgtttgttcttagaactgttttaacttttgggctactttggtttcacaggaattttagaaaattttttttctaatttcattgaaaatgttcatggtagtttgatagaaatagcactgaatcagtaaagtattttgggcagtatggtctttttaacaatattaatttttctataattgagcatgaaacatatttctttttgttggtattgcttctaattttgtcaacagcattttgtaatgtttgggtagagatttctcacttccctggttagctgtatttctaggtatcttatctgtggctgttgtaaatggtagtgcattcttgatttggctgtcagattggaggttgttggtataaaaaaatgttactgatatttgtacacacattttgtctcccaaaactttgctgaagttgtttttcagaagtgggagcttttggacaggggctttagggttttcactgtataaaatgataactctgtgaagagagatagtttgtctttctctctttctatttggatgccttttatttttctcttttactctggctaggacttccaatactatactgaatagcagtagttagagtggccatcactgcctttttccagttctcaagaggaatcctttgagcttttgctcattcagtatgatgttgactgtgggttttcacagatggctcacactatttttgagtatttttatttaactcataatttgttcagggatttttaaaatgaaattgagatcaaacaatcattaaaaaacatcaacaaaactgaaagtttgttatctgaaagagtaaataagatggataaatcactagatagactaaaaaagaataaaaaagggatgatccaaataaacacaatcagaaatgacaaagagaagatcatcattgaccccaggaaaaacaaactacctgcaaagatcattatgaatatctctatgcacacaaacttaaaaacctagaagaagcagatatatttctggacacttacatcatctcaaagttgtaccaggtagaaatagaaatcctgaagtgacccaaaatgtgttccaaaattgaatcagtaatataaagtccagcaaacataaaaggcctgaatcagagagattcacagccaaattcttttatacatataaaaagaaatactagccatcctactgaagctatttcaaaaaattggagaggagggcctcctacttaactaattctatgaggccaagattgctctgataccaaaacctggcagagacacaggaagataagaaaatatcatgccaatatccatcatgaacatggacacaaaaatcctcaacaaagtactaactaatagaattcagcagcacatcaaaacctaaccaccacaatcaagtaggcattaatcctaggatgcaagattggttaaacatatgcaaataaataaatgtgattctccacatacataagactaaaaagaaatacaccacaatcatttcaatagatgcagcaaaggctttcaaaaaattcaacatcactttccttttttattttgaagcactctcaaaggaaacaatttaatacttctgctcaaacttcaggagatagtggtaacagactactactaagatatctccataatcttgggaaagactgtggctactacaaaatgaagcttgtgtgctggaactcccttgacagtgaatgaaagagggaatcagaaggcttatgacagtggatacattaacatagacatcctataccatgttggaaatctatagaatgtttgctgaagttataatgaatgttcaatatgtctaccctctgagggctaggtccttttggacttaccaaaccaatctcactgatatgatttatgatcagatattgaaataatagagaccttcagaaggcagatggtcaaaataaacaagagcactaagactggggtgttatccagaaagacctaatttatgaaagctgtgtatatagtaacagagaagatagcactaggggcaaaatagataggtgagcaagggaatttctcaatctataataccagaagagttcaagaatggatactaaaaagttgagggcagctgtcctcactagaaatcacagtaaattgtcaagggtctggacctaagtgtgttttcagacctgaaatttattgactgaagaagacaccagtggctccaggggaaaaaaaacagtaaactgtaaaaccaaggaaacttacatgctactgattccataatttttttttttttcctgaaatggagagtggcatccctaggataactgatgatttcctcagcctccaaaatgcataattttttagatccactttgtctttagaaaaccgtgaaattgtatcattggtgtctggatacaagtcattttagtggaaaaagccaagtggattctctttgcattagtttcctggcttcttaaaacagaagttattctctgttattcttatctctctaagccagaaggtcaaaatctgtgttctcagggttcatttgttctggaggctctaggagggaaacaaccaatgcctgtctcttggcctttattggttaccgacaattcttggaatcccgtggcttgtgacttctctccaacttctgtttcctcagcatcatcttttcttttctttcttactagttttatcctgcctttattcttttcaaaagaaactgtgtcttgctatattgacttggctgatcttgaactcctggcctcaagggatcctcctgcctttctccttataagaatatctgtcattggatttaaagcacatcgtaaatccagaataaacttgtcttgattttcttactttacttacatctgcaaagatcttttctccattaaattcactttaatagattctggaggttactcactgcacacatttttggcaaagacatctattcaattcactatatgcatgcaacttcttcattcctccattaccacagatgtcaggtgaccaagaaaatggaaaataatattgcattacatgcctggggattgtgaaaattaaagaccttaaaggtttaaaggatgcaggatgatgggctccattacatctttgattaaaagtctgaccactgcaaaatccaacagatcctagagtctggtagtggactcctgcaatttccaccaagtagttgctccactggcatcccctgttccagatggagtacctttgctagaccacatgaaaattcatattattaaaatgtctgtactcctgacagtgattaatagatttactgcaatctctattaaattcctatggtatttcttatagaattgaaaaaacttaaaatttatatgaaaacacaaaagactgttaatatgcaaacatgatttttttaaaaatgcacagaatgatcttatatattgcttttaagaaagcaactataagactttatagaaaaaatactttcttttataggttagaactgaatctactcagttttattcaagattaaatctgtccacttcttcttcacctcagaatgttaacgtttttataggattattcaaaagtaccttaattatgccctgttctgcatgcacaatccaggagacagtaagttcagagaattatagtccaacttgtttggactgacttttgttccaattttggggattggcttttggtcgttcatttcttctacggtcaaaatgtaagtggactcattttgatccatgtcatctctctcgaaagaaatatgctgtttccaaattttaaactgaacttagcttggaaaagaaggcctagtaacagagataggagttgtcattatatctctagctatcattatataatgaaagccagactttgtcaactcactcttttaccagaattttaaactccctaatagatgattgaagtgataacatgatttcctttaatgctgctcacagacttcccactttatttagaaaattcattattatagagcctgggtgatggataaagtaaggcattcacttgtttttcttatgttatagacagaagctgggtttcggtccataatatcaaaatgtcatctgttatttatattgacataactttctgaaaacagtgcaagtcaagatttgcagtgtttaatgaaacctgaattttgaaattttacctccttttgtgggaaataattttaagaatcagatatagagtttaaaatttaaagttctgtcggatctaggaaagattattttgctatatttgtgtttctctctgtgaaatttttgatcaccaattccaataaaaaccacaatagcattttctccagagatttcaatgaattctttgatttcctgtaaagaaataatttgtacatcaataagagaaatgcatcatataaatttcaaaaatagatgcatataattttaatagctttactgaaggaagaacaattgatatacaaaaaacctgcaagtatttttacttatatatttatattatttatatatatataaattgatgagttttgacatatacatgcacctatgatgctatcattacaacaatgaaggtaataaacatatccatcacctacaaaagctctctttgtcactctttgtttttgatagtaataatgcttaacatgagattgaccctcttaacacattattaagtgtacaataccgtgttgttaactataggcattatattgtagagcaaatttctatgcttattcataaacataagtgaaactttatacccactgaacaacagctccccatttctctctctcccaaacccctggaaatcactattttatttctgcttcaattagtttgcctattttacttaactaatataagtggaatcataaaatatttgtcctttttttattattatactttaagttctagggtacatgtgcacaacgtgcaggtttgttacatatgtatacatgtgccatgttggtgtgctgcactcattaactcatcttttacattaggtatatctcctaatgctatccctcccccttcccccaaccccacgacagaccccggtgtgtgatgttccccttcctgtgtccatgtgttcccattgttcaattcccacctatgagtgagaacatgcattgtttgtttttttgcccttgtgatagtttgctgagaatgatggtttccagcttcatccatgtccctacaaaggacatgaattcatccttttttattgctgcatagtattccgtggtgtatatgtgccacattttcttaatccagtctatcattgttggacatttgggttggttccaagcctttgctattgtgaatagtgccacaataaacataagtgtgcatgtgtctttatagtagcatgatttataatcctttgggcatatacccagtaatgtgatggctgggtcaaatggtatttctagttctagatccttgaggaaacaccacactgtcttccacaatggttgaactagtttacggtcctacaaagagtgtgaaactgttcctatttctccacattctctcccacacctgttgtttcctgactttataatgatcaccattctaaatggtgtgagatggtatctcattgtggttttgatttgcatttctctgatggccagtggtggtgagcactttttcatgtgtctgttggctgcataggtgtcttcttttgagaagtgtctgttcatatactttgcccactttttgatgggtttgtttgtttttttcttgtaaatttgtttgagttcactgtagattctggatattagccctttgtcagatgagtagattgtaaaaatcttctgccattctgtaggtttcctgttcactctgatggtagtttcttttgctgtgcagaagatcttcagtttaatgagatcccatttgtcaattttggcttttgttgccattgcttttagtcttttagacatgaagtccttgcccatgcctatgtcctgaatggtattgcctaggttttcttctatggtttttatagttttaggtctaacatgtaagtctttaacccatcttgaattaatttttgtgtaacatgtaaggaagggatccagtctcagctttctacatatggctagccagttttcccagcaccgtttattaaatagggaatcctttctccatttcttgtttttgtcaggtttgtccaagatcagatggttgtagatgtgtggtattatttctgagggctctgttctgttccattggtctatatctctgttttggtatcacaaccatgctgttttggttactgtagccttgtagtgtagtttgaagtcaggtagcatgatgcctccagctttgttctattggcttaggattgacttggctatgagggctcttttttggttccacatgaactttaaagtagttttttccaattctgtgaagaaagtcattggtagcttgatggggatggcatttaatctataaattaccttgggcagtgaaggcattttcacaatattgattcttcctatccatgagcatggaatattcttccacttgtttgtgtcctcttttatttcgttgagcattggtttgtagttctccttgaagaggtccttcacaacccttgtaagttggattcctaggtattttattctctttgaagcaattgtgaatgggagttcactcatgatttgactctctgtttgtctgttattgatgtataagaatgcctttgatttttgtacattgattttgtattctgagactttgctgatgttgcttatcaccttaaggagattttggactgaaatgttggggttttctaaatatacaatcatgtcatctgcaaacagggacaatttgacttcctcttttcctaattgaataccctttatttctttctcctgcttcattgccctggccagaatttacaacactatgttgaataggagtggtgagagagggcatccctgtcttgtgccagttttcaaagggaattcttccagtttttgcccattcagtatgatattggctgtgggtttgtcataaatagctcttattattttgagatacgtcccatcaatacctaatttattgagagtttttagcatgaagggttgttgaattttgtcaaaggccttttctgcatctattgagataatcatgtggtttttgtctttgtttctgttcatatgctggattatgtttattgatttgtgtatgttgaaccagccttgcatcccagggatgaagcccacttgatcatggtggataagctttttgatgtgctgctgtattcagtttgtcagtattttattgaggatttttccatcaatgttcctcagggatattggtctaaaattcttttttgttgttgtgtctctgcccggctttggtatcaggatgatgctggcctcataaaatgagttagggaggattccctctttttccattgattggaatagtttcagaaggaatggtaccagctccttcttgtacctctggtagaattcagctgtgaatccatctggtcctagaccttttttggttggtaggctattaattattgcctcaatttcagagcctgttatttgtccattcagggattcagtttctccctggttcagtcttgagagtgtgtatgtgtccaggaatttatccatttcttccagattttctagtttatttgcatagaggtgtttatagtattctctgatggtagtttgcatttctgtgggaacagtggtgatatcccatttatcattttttattgcatccatttgattcttacctcttttcttctttattagtcttgctagtggtctcccaattttgttgatcttttcaaaaaaccagctcctggattcgttgattttttgaaggctttcttgtgtctctatctccttcagttctgctctgatattagttatttcttgccctctgctagcttttgaatgtgtttgctcttccttccctagttcttttaattgtgatatttgggtgtcaattttagatctttcctgctttctcttgtaggcatttagtgctataaatttccctctacacactgctttgaatgtgtcccagagattctgttatgttgtttcatagttctcattggtttcaacaaacatctttatttctgccttcatttcttatttacccagtagtcattcaggagcaggttgttcagtttccatgtagttgagtggttttgagtgagtttcttaattctgagttctagtttgattgccttgtggtctgagagatagcttgttataatttctgttcttttacatttgctgaggagtgctttacttccaactatgtggccaattttggaataactgcaatgtggtgctgagaagaatgtatattctgttgatatggggtggagagttctgtagatgtctattaggtccgcttggtgcagagctaagttcaattcctggatatcctttttaactttctgtcttgttgatctgtctaatgttgacagtggggtgttaaagtctccagttattaatgtgtgggagtctaagtctctttgtaggttactcaggacttgctttatgaatctgggtgctcctgtattgggtgcatatatatttaggatagttagatcttcttgttgaattgatccctttaccattatgtgacagccttctttgtctcttttgatctttgttggtttaaagtctgttttatcagagactaggattgcaacatctgcctttttttgttttccatttgcttagtagatctttctccattcctttattttgagcctatgtgtgtttctgcacatgatatgggtctcctaaatacagcacactgatgggtcttgactatccaactagcaatttggataaaatatcttctaattggagcatttagcccattgacatttaaggttaatattgttatgtgtgaatttgatcctgtggttatgatgttagctggttattttgctcgttagttgatgcagtttctttctggcatcgatggtctttaaaatttgtcatgtttttgcactggctggtaccagttgttcctttccatgtttagtgcttctttcaggagctcttgtaagacaggactggtggccacaaaatctctcagcatttgcttgtctacaaagtgttttacttctccttgacttatgaagcttagtttggctggatatgacattctgggttgaaaattcttttctttaggaatgttgaatattggcccccactctcttccggcttatggagtttctgctgagagatccactgttagtctgatgggcttccctttgtgggtaacccgacctttctctctggctgcccttaatattttttccttcatttcaactttggtgaatctgacaattatgtgtatttgagttactcttcttgaggagtatctttgtggcattctctgtatttcgtgaatttgaatgttggcctgccttgctaggttggggaagttctcctggataatatcctgcagagtggtttccaacttggttccattctccctatcactttcaggtacaccagtcagacatagatttggtattttcacatagtcccatatttcttggaggctttgttcatttcattttactcttttttctctaaacttctcttctcgcttcatttcagtcatttgatcttcaatcactgataccctgtcttccagttgatcgaatcagctactgaagcttatgcatgtgtcacatagttctcctgccatggttttcagctccatcaggtcatttaaggacttctctacactggttattctagttagccctttgtctaatcttttttcaaggtttttagcttctttgtgataggttcaaactttctcctttagcttggagaagattgatcatctgaagccttcttctctcaactcttcaaagtcattctccatccagctttgttccattgctgatgaggagctgtgttcctttggagggggagaggcactgtgatttttataattttcaacttttctgctctgttttttccccatctttgtggttttatctacctttggtctttgtttatggtgacgtacagatgggattttggtgtgaatgtcttttctgtttgttagttttccttctaacgttcaggaccctcagcttcaggtctgttggagtttgctggaggtccactccagaccctgtttgcctgggtatcagcatcagaggctgcagaacggctaatattgctgaacagcaaatgttgctgcctgatcgttcctgtggaagctttgtctcagaggggtacctggccgtgtgaggtgtcagtctgcccctactgggggggtgcctcccagttaggctactcaggggtcagggacccacttgaggaggcagtctgtctgttctcagatctcaaactctttgatggggagaccactactctcttcaaagctgtcagacagggacagttaagtctgcagaggcttctgcttccttttgttcagctatgccctgccccccagaggtggagtctacagaggcaggcagccctcctgagctatggtaggctccaccttgttccaccttcctggccgctttgtttacctactcaagcctcagcaatggcgggcacccctcccccagcctcacagctgccttgcagttcaatctcagaatgctgtgctagcaatgagtgaggctccatgggcatgcgaccctccgaaccaggcatggaatataatctcctggtgttccatttgctaagactgttggaaaagcgcagtgttagtgtgggagtgacctgattttccaggtgccatctgttacagcttcccttggctaggaaagggaattccctgatcccttgtgcttcctgggtgaggagatgcctggacttgctttggctcacactccatgggttggttgcactcactgtcctgcacccactgtctgacaagccccagtgagatgaacccagtacctcagttggaaatgcagaaatcaaccatcttctgtgccgctcatgctgggagccatagactggagctgttcctattgggccatcttggaactgccccccatattagtccttcttgaacttgcttaattcacttagcataataccctctaggttcatccacattgtcacaaatggtaccttttgtcaaaccttggcaactgaattgacatttctactgcttccatatacagagaaattatactaactgaacttgtgaaaataatttattgatattaaattaaaatgctcatgaatagtttttgaattcttgtaagatcagatatggagaaaaatctcaaatttgtctttattttaatgaatgaaaaatatttatgattttgaaataattagcaatgggaaactaattaggaaaattgagatttttagattgttctactgttttgattattattgacataacataatatatcgtatatttctatatttactttaaaatacatgtttatatatacatatatatatatagacagagccatcgtgagtaaattagtgtgtatgtgtagtgggggtgtttgtgttttctttaatggatactctagcagcagttatctagtgtatgtcatgtactaattaatattgcatcccagaaacaaatcctaaaactgctttaaatttgtatcttttctctctcttctttctaagaaagaaatgtatatatggaacaatactctctgaatttgtttcattttagtataccacatgatagtgtggtgaaggagtgtgaggacaggcagacagagatgggagaaatggagagacagagagagaaagaaagaaagaaagagacagagaacttattatagtgaagccttatttatctttgtatcatgaggggctagctcaggacctggcatgaatggagcttataaagtgtatattaaaataaataggccacttatgacatgggttaagtcattcatattccaaatttaatgtaagaggttcgttctagcataaatatatatcttaggctttacaataaagtaaaatattgttacttttatacatatgatataggtttaattttgagagcacgcacaatatttatttaaaaatgctccttaaataaatttaaaaatatatttctacatgaatataatgtaacattaccaattttattgagtctctgtttttttcttataaaaagaacttacaatgataatacataagtaaaactgtaataattatacctactagacacataaaagctttgaattgaagaaaaattttacaataatctgtgtcaggttatgatttaaatttagaattactgtattctaaattctcaaacagagatcatcaatattttttagttatggtactgaattcaatagaactttaaatgtacatcatgtatgtgagctgacatagaggaatcatgattaagtaaatcaaaatagtattaatgttcaatgacatgtggtagagagaaatatttgatttttaagttagaatttaggcattcaaaacaggaatcacaggaataacaaaaggacataactctgaactatgcacaccagataagcataaaatttattttgcaaatgtttttgcagtttagtcctttgcatcagtttatattgtgggaaagtaagggagcaagaacagctgaaatgatataacacataaaaatatcagataatttttattgtaaacagatataagctgaatttgaaaacaaaattgataagaaattaaagaggaatatatttcccacttgttcctttcatatataatccaaagcctaaaattatgattctttatagaaatatcttcctgcttttctgtcatttgtcaaaagaagaataaaatcaatatttatttttagggctacattactgcatcatgaacctaaacttaattctgactctagaaaccaagtcaaaccatcaagaaatgtaaaccatgagcaaatgagaataaatgcaataaaatcacatccaatataaaaggcacggagatactacaaagagtaagaaacatcagaaagggtttaggtgaaaatataataaatattccttttctaaaatgttgtggtagtaatagtttattacttaatctacaaaaaatattgtcagtatttccatacttaccgaaatgagtatgatacctcagcctcactccttcagtatctttttaaatctattaccgtactacagtatcatttcaacaatgttaaatatttaatcacaatttaaatattaaatattaatgataaggataataatcctttactatgacctatactattcataccgttctggaaatataacatataataccagcagatcgcaagttagatagaccaaaaccctctcaaaaccaagaacaaacaaacaaaaaatacaaagcaaaacatttagcctctgcatttaaggcatgtttttcatcaatcctgatgtgctgccgggaatatacaaagaagaggtaagacatctgggattcccatgggaaaccagaaacgaatatataaatgaaatgttgagaagcccagccatcaattctccatagtaagctaaagggtcagcaaaacaaataaacttggctgcctacagcctgctgagtaactccttatttttatttgcctgccacaccatgaaagactctgcagttctaaagaagctttgtagagaaaagcaaagatatcttctgtgagggtttcttagtttactgaaagtaggagaaccttcacattaaaaggaatcagcatgatcaagcagaaggcttggtggaggtgctaacatggttatctcatatccatcaagttggagtttttctagaataacttttaaattgagtgactaaaattcatgggccagacaagtactttcccaaactttccagagtcaaagaaacacagattcagcaggaaaaaaaaaacaaaaccaaacacacacacacacacacacagaagacattcacagttttcatgaccaactcttcctttaatttacccttggtttaaaataagtacagcaagctcataagccagattcatcctaaatgtgtttcatgctttaatttctcagtcaattgatggtgaatgagtctggactttggacagcctacttattccaatagtcaaagtggaatatagctgtcctcatggaaaagatcatcaaattaagcaatatagcacaaattacataaaagctttctaaaataattttatataataggaatttatgcacttaaaattaaatacaacggaaaggatttctggttgagtctaagaaagttttccatgagatcttaattgttctaataagaagatttggattctcttctttagatttattggaatgttcatttggacatcttatttattttcactttgtttatcttaatgttgggataatagaaagcatagatattgagaatgcatactctactattggtattttttttgtcaaaatgtataatttattttgaaatgttaaatagtgcttatgggctgagtcatggctcattactcagaattcatttgtttgtgttctaaccccaagtacctcagaataggactacatttggagacagggccattatggaaaaaactaatataaaatgagggcatatagagaatatcttatatggacataaggacaaacacagagaaggaagtccatgtaaaaacactgaaggaaggcaaccatctacaaaccaatcataatggctttagaagaaaccaactctgttaatcacactttgattacacacttctagcctcctgaatgtgagaaagcatgttccttggagagaagcacaacacactgatcattagagaaatgcaaatcaaaaccacaatgagataccatctcacgccagtcagaatggtgattattaaaatgtcaagaaacaataaatgctggtgaggctgtagagaaataggaatgcttttacactgttggtgggaatgtaaattagagctaggtctttgagattatgttgattaattgatatccaatacaaaccaagttcaaagtagatgagtagttagagagagggtaaaaaatggagagttaaaaattaataaataataaagcagtctagatggtatacacactacttttaagggagcttttttttgaagtttagtgaaacttatgtaacttttaaaaatttcaattttatttgtaacttctgagtgattggttgtgttaaaaaagttaccatacaatttcccatcttaacaatttttaagtttgcaattcagcaatgttaaagtatatttacatttttgtgccacaggtttctagaaaatgttcatcttcgaaaacacattgaacaacataccattttccctttactccagcccctggtatccactattccactttctctttctatgggttttactacttttgacaccacatgtcagtgaaatcacttatatgtgtatttatctttttttgactggcttattcaacttgttataacatcctcaagcttcatcaatgttgtcacatacgatagaatagaattttccttttttacaagctaaaaaaatcattcatttcatttatataccatgttttctttgtccattcatccatccatggacatttgtgttgctttgctctcttgactattgtgaataatgttgcaaagaacatggatgtgcaaatatgtctttgagatcctacttttaattattttggataaatacctagaagtaacattgttgggtcatatggtaattttattttattttatttttttgaggaacctccataccttaactatacgggtgtcaccatttttcattcctaacaataatgcacaagagctcctatttatatatattatcttcaatactttttgttttctgggctgtgtgtgtgtgtgggggggggggtgtgtgtgtgtgtgaatatatgtattcaaaaatattttgaggtggctaatggttatgatgtgatagttcattgtaatttaggtttacatttctctaataattagtgatgttaagcatcttttcatatgctttttggccatatgtctatattttctgaataaatgtgtattcaagtctttgaattattttaattgaatttttgctattaaattatagggaattgtcatatattttgaatataaaacacttagctgataaattatttaccaatattttctttcttgcaacctatttctatggcatcagttgtaatgtcttctctttcttatttctttttgtttttggcttggtctttgttgtgtctccaggctgcagtgcagcagcagcaccatctcagctcactgaaaccctcacttcctgagttcaagcgattctctcatgtcagcctcctgagtagctgggactacaggtgcatgccaccacacctggctaatttttgtagttttagtagagacagggtttcaccatgttgcccagactggtctcccactcctgggctcaagcagtcagcctgcctcagcattccaaagtgctgggattacaggcataagccaccatgctcagcctgattttaattatacaactattcgctttttttaatcaagaaaacaatttcttgattttgttgatcttttcaaaaaaagaaagcaataactcagttttgctgatttttctctattttctattgtatttatttctgctgtaatctttattacttttttctttctgataattttggtcagttctttgatatgtaaagttagattgctttagatatttcttctttttaacataggcatttattactataaactattttcatagtattgtttttgctacatttgtaagttcaggttccttttttcacttctttttgtgtatcttctacagcaagcttgtccaacctgcagcctgacaggtgcatgcagcccaggacggctttgaatgtggcccagcacaaacttgtaaactttcttcaaacactgtgatttctcttacgattttttcccagctcatcagctatggctagtgttagtgtattttatgtgtgtccaagggcaattcttcttttcccaatgtggttcagggaaggcaaaagattgggcacccttgttctataggtgtattttgtggttaccaggaggattgcatgaagtattttataataaacattatataataaaacaaatttaaaaataaataaataaaatataaataaaataaaatataaaattaattttatataattataaaataattacaaattataaaaataaaatataaataaatattaaataaaataaacattttaaaataacagttcattttaaacaaaaaaccctttaattatacatgaaaagtctattcctttacatctcccattcctactttatgttagcaatatcactagttgtatattttgtgttgtgtcccaattaatataaatgtaatgttacttttatgcttttctcttttaaattgcatatcagaattaaaagaaacttgtgaagcaacattaaaaacttatgggattttatatttaattacatatttatctctaccagagaaatttatacttttacattcattcattttgctacctagtctccctcatttcaacttgaaagactcctttttgcttttctgtaggacaggtgtggtaataattaccttcttcaaccttttttaaacccgagaaaatattcaattttccattatttctgaatgacaggtttgccaaatgaatgtcttgtgtggtaggttttttttttcttttctgatttttctttcaacactttgaatatgttacatcacttacttttggtttaaaaagatgtctgctggtatcttgttgataataccatgtgagttcccttttatgtcatgattcatttttcttctgcttccgagattctttctttgtgacttttgaaagtttgattatgatatttattgatgcaaaatttttgaattgatctcagtgtacggtagttgtattttaaaacaattctatgtccatattcttcctcaaatttgggaattgtctgcctgccattatttctttaaatagactttttatctcaatcttttcctcttgtcccatgagggctctcataatgcataactggtcaggttaacaatgtcccataagcctccggctttcttcattttattatgagattcttcttgctcctctcccttaatagcttgaaatggccaatatttcaaattcatgaattatttttttctagctgaacaagtcatctattgaatttctctagtaaatttttcaatttagttattgtattatttacctccagaatatctatgtggttgttttctataatttttgtgtctttgttgatacttttatttcatatatgtattattttcctgatttttaaaaacttgtctatgttcttttagttaatcgagcatctttaattatttttgaaatttttgataggtatttaagatattttgaattttttgacaggtaatggatagatctttgttcattcaggattgaaaaaaggtttactttgttcctttaaacaggtcatgctttccaatgtctgcatgttttgcatttctttgtttaaattttgagatttaaagaaacacccacatctcccagtctttatgtactggcttagtgtagggaaataccttcatctatcacccctcctagagattctgggagttttgtgaaccattccaagagctgtagcctctccaggcttttgaatgtaattactaagttaaatccagtttttgtttgtttgtttgtttgttttcaggattttgtaatattttacttcacctgttgtcattctgtagtaataatgcagctcttctggtactgccctaaactgccccactgcctttattcccaggcattcaaatgctggggtttctataggtgatttaagctcagtgacagaaatcagacccttgggaagtctctaaggagccagaacattagaccacatttcaattagagcactagaatattctgaatttgtctatatatttacatttaccagtgactttttatatttttatttgttacatgttagtgtccttttcctttagagtgaaaaataccctttgcatttcttcttaaacaggtttcgtgttggtgaattctcctagttttatttgtcttgaaaagtctttatctcttcctcatatatgaagaagtgctttgatgagtacagtatttttggattaaaggtttttcaaatttttgattacttcagcatttggctatattatcccactctcttcttgcctgcaagtttgcttttttttctttctttctttttttttgttttcactgaaaattcactgaaaaccatttggtaacactattgaatgtgttatgttttgttgttgttgttttgttttgtttttctatctctcctgctgctttcagtattgtttttgttctttgatttttggtaatttgattataatgtgctttgggaattactttctgcgttgaatttgtctggtgttgtccaagctaactgttcccagatattattgtctttctccaaatttggaaaacattgagttattatattgagtttgttttctagtcctttcttttctcatatcctctagaaacttaaattatgtggaggtagttcccttcatagtgtcataaaatttctgtggccgccattctttctttttacttttatccctctgattgggtaattacatgttttctttctttgagcttactgattctttcctgtttgatcaagtctactgttaaagttttctaatgagtttttcagtttaacaattttatcctgcatttcaaggatttcatttttttattattttgatttctttctgaaatgtctaatattgtgtctgcattattttccaagtttcttttagttttttgattatggtttatgtgattcctgaacttttcaaagagatttattttgaatttgttgtcagatatttaagcatcttcgaatctttttgtgcattattgaaacttgattggtttcttttggagatgtcatatttccctgttttttttttttttttttaacaatacttgctgtttacattgatgcctgcatatttaagaagatggccacttgattcagctttttaatgtgttatgcagtggtgttaaaatattactgcttaataccagagctgaatcactaccctgagcattctttctgttctgaggatggcttatatttgatagcagaacctaaatagtgcattagagctaaatctcttccatgctgttgttttcctgtctggggaagacttatcatgaccatgaaaacacaatgctgcaccagaacttaaacccaaagccgtaataatttccgggttggggaaggcttaagaaataactagaacttagttacttacctgatagttgtttctgggtcagagaaaggctctgtatgatcacctgggttatttgtaaaatctgaccaaagattctagccttcccctggattgtgcctcctgtactactgtagtgctggctagcccccccatcaatgtgaattccctgttgataggaacacaaagcgtctgccaagatctgtttgccatttgctgtgattagtgcttctgctctttgcttccaattcaacccaggtggttcagtccttctgacactcctaatacctcctgtgggatggaaaaaagaagatttctcacaatgattcacaccctgacatggggactgagcgtccacctgcaattattttcttccacctgggtaattgcaggtacagggaagttttctgtgagtggtgctattttggtttggagaatgggttgatgcagcacaaatgacctttcttctttctggtcatggattttttaatttccatgaaccaataagatttttcacctttctcctgagctccggtgcattcagagtggtatttttatatttgaatagttgctagttgtacttttaagatggattgatgctagaggtcttcagttccaccatcttgctgatgtcactactcaaaaatatttttacatgttaggaaattattttgtttttaggattttgtgtctacgtgacacagacatgaaaagagatgtactcttatcactgaaacttttcgtatactgttttggttgtgtgcattttctagtcatgaatgattatttatttaagccatatgttttacacatagactttcttaa
